United States Patent 10,858,665 (ISOLATED POLYNUCLEOTIDES, POLYPEPTIDES AND METHODS OF USING SAME FOR INCREASING ABIOTIC STRESS TOLERANCE, BIOMASS AND YIELD OF PLANTS) - sequence listing, part 5

SEQ ID NO: 10004 - protein, 183 aa, Flaveria ramosissima
MKQPMMPNPMMSSSFPPTNITTDQIQKFLDENKQLILAIMTNQNLGKLAECAQYQALLQKNLMYLAAIADAQPPTPTPAPASTISSQMGPLPHAGIPQQGGFFMQQHPQAAVMAQQMPAMQFNSPQVIQPQMGVRPGGPSVAPPSSTAGDVWRGSMQDGGPAESSGAGKDGHGAATGGSDEAK

SEQ ID NO: 10005 - protein, 205 aa, Ambrosia trifida
MMPNPMMSSSFPPTNITTDQIQKFLDENKQLILAIMTNQNLGKLAECAQYQALLQKNLMYLAAIADAQPPTPSPAPTISSQMGPLAHAGIPQQGGFFMQHPQAAVMAQQSPSFPQQMPAMPFNSPQVMQPQMGVRPGGPSGPSSVPPSSAAGDIWRGSMQDGGGADGSGSGKEGHGAAAGGPDEGNNENEWIVSQMDVDRCGLLR

SEQ ID NO: 10006 - protein, 505 aa, Ambrosia trifida
MPLLDSLTAISLLLLVRVLCVHASVHNYAGVKFARKGNAYVVHGGSEGIYYSHPNLNDSKAFSNGDAYIKFEKIVFRRPQEASNFSTGMIYAILFEVDDRETIGGSAYGGQRAVCCTADLAKLGACKEGEVIHRLSTTNPGWPEVFGVSFDVNDETSTMQPRSVQITRTGMYNLYFMHCEPRLVDLVVEGETIWKNPNGYLPGRMAPLLNFYGFMSLAFLVLGIFWFSQYARFWKEVLHLQNCITLVITLGMLEMALWYFDYAEFNESGVRPTGITIWAVTFGTIKRTVSRLIILTVSMGYGVVRPTLGGLTSKVVMLGGTFFVASEVLELVEHVGAVSDLSGKAMLFLSLPVAVLDAFFVLWIFTSLSSTLNKLQAKRMMAKLDIYRKFTNALAVAVIVSVGWICYELYFKSTDIYNEQWQNAWIIPAFWHVLSFSLLCVICALWAPSQNSMRYAYSDDGSEEFDKDDTLTLIKPSPVSVPVSKKDVAELRSDDEVDLEEDKTE

SEQ ID NO: 10007 - protein, 505 aa, Ambrosia trifida
MPLLDSLTAISLLLLVRVLCVHASVHNYAGVKFARKGNAYVVHGGSEGIYYSHPNLNDSKAFSNGDAYIKFEKIVFRRPQEASNFSTGMIYAILFEVDDRETIGGSAYGGQRAVCCTADLAKLGACKEGEVIHRLSTTNPGWPEVFGVSFDVNDETSTMQPRSVQITRTGMYNLYFMHCEPRLVDLVVEGETIWKNPNGYLPGRMAPLLNFYGFMSLAFLVLGIFWFSQYARFWKEVIHLQNCITLVITLGMLEMALWYFDYAEFNESGVRPTGITIWAVTFGTIKRTVSRLIILTVSMGYGVVRPTLGGLTSKVVMLGGTFFVASEVLELVEHVGAVSDLSGKAMLFLSLPVAVLDAFFVLWIFTSLSSTLNKLQAKRMMAKLDIYRKFTNALAVAVIVSVGWICYELYFKSTDIYNEQWQNAWIIPAFWHVLSFSLLCVICALWAPSQNSMRYAYSDDGSEEFDKDDTLTLIKPSPVSVPVSKKDVGELRFDDEVDLEEDKTE

SEQ ID NO: 10008 - protein, 500 aa, Arnica chamissonis
MPFLDSLTAISLLLFARVICIQASVHNYAGDKFSRKGNAFVVHGGSEGIYYSHPNLNDSSESSNGDAYIRFEKIIFRRPQEASNFSTGTIYAILFEVDDRETIGGSAYGGQRAICCTADLAKLGACKEGEVIHRLSTTNPGWPEVFGVSFDVNEETSTMQPRSVQITRTGMYNLYFMHCEPRLVDLVVEGKTIWKNPNGYLPGRMAPLLNFYGFMSLAFLVLGIFWFSQYARFWKEVLHLQNCITLVITLGMFEMALWYFDYAEFNESGVRPTGITIWAITFGTIKRTVSRLIILTVSMGYGVVRPTLGGLTSKVVMLGGTFFLASEVLELVEHVGAVSDLSGKAMLFLSLPVAVLDAFFVLWIFTSLSSTLNKLQAKRMMAKLDIYRKFTNALAVAVIVSVGWICYELYFKSTDIYNEQWQNAWIIPAFWHVLSFSLLCVICALWAPSQNSMRYAYSDDGGEEFDKEDTLTLIKPSPLSTKDATELKSEDVDLEEDKTE

SEQ ID NO: 10009 - protein, 189 aa, Flaveria ramosissima
MPLLDSLTVISLLLLLVRVVHIQASVHNYAGDKFVRKGNAFVVHGGSEGIYYSHPNLNGSSASSNGDAYIRFEKITFRRPQEASNFSTGMVYAILFEVDDRETIGGSAYGGQRAICCTADLAKLGACKEGEVIHRLSTTNPGWPEVFGVSFDVNEETSTMQPRSVQITRTGMYNLYFMHCEPRLVRSRL

SEQ ID NO: 10010 - protein, 498 aa, Flaveria ramosissima
MPLLDSLTVISLLLLVRVTHIQASVHNYAGDKFVRKGNAFVVHGGSEGIYYSHLNLNGSSASSNGDAYIRFEKITFRRPQEASNFSTGMIYAILFEVDDRETIGGSAYGGQRAICCTADLAKLGACKEGEVIHRLSTTNPGWPEVFGVSFDVNEETSTMQPRSVQITRTGMYNLYFMHCEPRLVDLAVEGKTIWKNPNGYLPGRMAPLLNFYGFMSLAFLVLGIFWFSQYARFWKEVLHLQNCITLVITLGMFEMALWYFDYAEFNETGVRPTGITIWAVTFGTIKRTVSRLIILTVSMGYGVVRPTLGGLTSKVVMLGGTFFLASEVLELVEHVGAVSDLSGKAMLFLSLPVAVLDAFFVLWIFTSLSSTLNKLQAKRMMAKLDIYRKFTNALAVAVIVSVGWICYELYFKSTDIYNEQWQNAWIIPAFWHVLSFSLLCVICALWAPSQNSMRYAYSDDGSEEFDKEDTLTLTKPSPVSVSTKDVPELRSEDVIGRR

SEQ ID NO: 10011 - protein, 486 aa, Flaveria ramosissima
MPLLDSLTVISLLLLVRVVHIQASVHNYAGDKFVRKGNAFVVHGGSEGIYYSHPNLNGSSASSNGDAYIRFEKITFRRPQEASNFSTGMIYAILFEVDDRETIGGSAYGGQRAICCTADLAKLGACKEGEVIHRLSTTNPGWPEVFGVSFDVNEETSTMQPRSVQITRTGMYNLYFMHCEPRLVDLAVEGKTVWKNPNGYLPGRMAPLLNFYGFMSLAFLVLGIFWFSQYARFWKEVLHLQNCITLVITLGMFEMALWYFDYAEFNETGVRPTGITIWAVTFGTIKRTVSRLIILTVSMGYGVVRPTLGGLTSKVVMLGGTFFLASEVLELVEHVGAVSDLSGKAMLFLSLPVAVLDAFFVLWIFTSLSSTLNKLQAKRMMAKLDIYRKFTNALAVAVIVSVGWICYELYFKSTDIYNEQWQNAWIIPAFWHVLSFSLLCVICALWAPSQNSMRYAYSDDGSEEFDKEDTLTLIKPSPVSVSTKMY

SEQ ID NO: 10012 - protein, 279 aa, Cynara scolymus
MPLPDSLTLISFLLLLSLICIHASVHNYAGLKFSRKGNAYVVHGGSEGIYYSHPNLNQSSASSNGDAYIRFEKIIFRRPQEASNFSTGLIYAILFEVDDRETIGGSAYGGQRAICCTSDLAKLGACKEGEVIHRLSAINPGWPEVFGVSFDVNEEISTMQPRSVQITRTGMYNLYFMHCEPRLGDMIVEGKTIWKNPSGYLPGRMAPLLNFYGFMSLAFLVLGIFWFSQYARYWKEVLQLQNCITLVITLGMFEMALWYLIMQNLTRVGCDQRGLPYGQ

SEQ ID NO: 10013 - protein, 504 aa, Lactuca sativa
MPLLDSLTAISLLLLVRVLCIQASVHSYAGEKFSRKGNAFVVHGGSEGIYYSHPNLNESSASSNGDAYIRFEKITFQRTEEAANISTGFIYAILFEVDDRETIGGSAYGGQRAICCTSDLAKLGACKEGEVIHRLSTTNPGWPEVFYVPFDSTDKSFIMQPRSVQITRTGMYNLYFMHCEPQLSDMVVQGKTIWKNPSGYLPGRMAPLLNFYGFMSLAFLLLGIFWFSQYARFWKEVLQLQNCITLVITLGMFEMALWYFDYAEFNESGVRPTGITIWAVTFGTVKRTVSRLIILTVSMGYGVVRPTLGGLTSKVVMLGATFFVASEVLELVEHVGAVSDLSGKAMLFLSLPVAVLDAFFVLWIFTSLSSTLNKLQAKRMMGKLDIYRKFTNALAVAVIVSVGWICYELYFKSTDIYNEQWQNAWIIPAFWHVLSFSLLCVICALWAPSQNSMRYAYSDDGSEEFDKEDSLMLIKPSPVATKEVSEMRSVLQSEDGDLEEDKTE

SEQ ID NO: 10014 - protein, 509 aa, Centaurea maculosa
  misc_feature (499)..(499): Xaa can be any naturally occurring amino acid
MPLPDSFTAISFLLLLLSFISSIQASVHDYAGDKFSRKGNAYVVHGGSEGIYYSHPNLNQSSASSNGDAYIRFDKIEFRRPQEASNFSTGLIYAILFEVDDRETIGGSAYGGQRAVCCTSDLAKLGACKEGEVIHRLSARNPGWPQVFGVSFDVNEEISTMEPRSVQITRTGMYNLYFMHCEPRLGDMVVEGKTIWKNPSGYLPGRMAPLLNFYGFMSLAFLVLGIFWFSQYARYWKEVLQLQNCITLVITLGMFEMALWYFDYAEFSESGVRPTGITVWAVTFGTVKRTVSRLIILTVSMGYGVVRPTLGGLTSKVVMLGATFFLASEVLELVEHVGAVSDLSGKAMLFLSLPVAVLDAFFVLWIFTSLSATLNKLQAKRMMAKLDIYRKFTNALAVAVIVSVGWICYELYFKSTDIYNEQWQNAWIIPAFWQVLSFSLLCVICALWAPSQNSMRYAYSDDGSEEFDKEDTLTLIKPSAAAAAVSTKDVSELRSVQIXSEDGEEDKRE

SEQ ID NO: 10015 - protein, 494 aa, Cirsium arvense
LLSLSRIHASVHNYAGDKFSRKGNAYVVHGGSEGIYYSHPNLNQSSASSSSNGDAYIRFEKIIFRRPQEASNFSTGLIYAILFEVDDRETIGGSAYGGQRAICCTSDLAKLGACKEGEVIHRLSAVNPGWPEVFGVSFDVNEEISTMQPRSVQITRTGMYNLYFMHCEPRLGDMVIEGKTIWKNPSGYLPGRMAPLLNFYGFMSLAFLLLGIFWFSQYARYWKEVLQLQNCITLVITLGMFEMALWYFDYAEFNESGVRPTGITIWAVTFGTVKRTISRLIILTVSMGYGVVRPTLGGLTSKVVMLGGTFFLASEVLELVEHVGAVSDLSGKAMLFLSLPVAVLDAFFVLWIFTSLSATLNKLQAKRMMAKLDIYRKFTNALAVAVIVSVGWICYELYFKSTDIYNEQWQNAWIIPAFWQVLSFSLLCVICALWAPSQNSMRYAYSDDGSEEFDKEDTLTLIKPSAAFPPKDASELHSVQIESEDGEEGKKRVR

SEQ ID NO: 10016 - protein, 475 aa, Cirsium arvense
PDSLTAISFLLLISSIHASVHDYAGVKFSRKGNAYVVHGGSEGIYYSHPNNLLNHSSTSSSSNGDAYIRFDKIEFRRPQEASNFSTGLIYAILFEVDDRETIGGSAYGGQRAICCTSDLAKLGACKEGEVIHRLSARNPGWPQVFGVSFDVSEEISTMQPRSVQITRTGMYNLYFMHCEPRLGDMVVEGKTIWKNPGGYLPGRMAPLLNFYGFMSLAFLVLGIFWFSQYARYWKEVLQLQNCITLVITLGMFEMALWYFDYAEFNESGVRPTGITVWAVTFGTVKRTVSRLIILTVSMGYGVVRPTLGGLTSKVVMLGATFFLASEVLELVEHVGAVSDLSGKAMLFLSLPVAVLDAFFVLWIFTSLSATLNKLQAKRMMAKLDIYRKFTNALAVAVIVSVGWICYELYFKSTDIYNEQWQNAWIIPAFWQVLSFSLLCVICALWAPSQNSMRYAYSDDGSEEFDKEDTLTLIKP

SEQ ID NO: 10017 - protein, 477 aa, Conyza canadensis
VHYAGDKFIKKGNAFVIHGGSEGIYFSHSSTNSNSSSNGDAYIRFEKIVFRRPREASNFSSGLVYAILFEVDDRETIGGSAYGGQRAICCTADLAKLGACKEGEVIHRLSTTNPGWPEVFGVSFEVNEETSTLEPRSIQITRTGMYNLYFMHCEPRLSDVVVEGETIWKNPSGYLPGRMAPLLNFYGFMSLGFLVLGIFWFSQYARFWKEVLHLQNCITLVITLGMFEMALWYFDYAEFNESGVRPTGITVWAVTFGTVKRTVSRLIILTVAMGYGVVRPTLGGLTSKVVMLGGTFFVASEVLELVEHVGAVSDLSGKAMLFLSLPVAVLDAFFVLWIFTSLSATLNKLQAKRMMAKLDIYRKFTNALAVAVIVSVGWICYELYFKSTDIYNEQWQNAWIIPAFWHVLSFSLLCVICALWAPSQNSMRYAYSDDGSEEFDKEDTLTLIKPSPVSTKDVTELRSVHSDDGDLEEDKTE

SEQ ID NO: 10018 - protein, 478 aa, Artemisia annua
MKEIASFPKKGNAFVVHGGSEGIYYSHLNPDSNSTKSSNGDAFIRFEEIKFQRPQEASNFSTGMIYAILFEVDDRETIGGSAYGGQRAICCTADLAKLGACKEGEIIHRLSTTNPGWPQVFGVSFDVNEETTTMQPRSVQITRTGMYNLYFMHCEPRLDDMIISGKTIWKNPSGYLPGRMSPLLNFYGFMSLAFLVLGIFWFSQYARHWKEVLHLQNCITLVITLGMFEMALWYFDYAEFNESGVRPTGTTIWAVTFGTVKRTVSRLIILTVSMGYGVVRPTLGGLTSKVVMLGGTFFLASEVLELVEHVGAVSDLSGKAMLFLSLPVAVLDAFFILWIFTSLSSTLNKLQAKRMMGKLDIYRKFTNALAVAVIVSVGWICYELYFKSTDIYNERWQNAWIIPAFWHVLSFSLLCVICALWAPSQNSMRYAYSDDGSEDFDKEDTLTLIKPSPVFTNDVTELRSVHSDDGELEEDKTE

SEQ ID NO: 10019 - protein, 544 aa, Carthamus tinctorius
LPWLAIDECFSLTHKPPDLCVVFLLDLINFSHQKEAMPLPDSLTAISFLLLLSFISSIHASVHDYAGDKFSRKGNAYVVHGGSEGIYYSHPNLNQSSASSNGDAYIRFEKIVFRRPQEASNFSTGLIYAILFEVDDRETIGGSAYGGQRAICCTSDLAKLGACKEGEVIHRLSARNPGWPEVFGVSFDVNEEISTMQPRSVQITRTGMYNLYFMHCEPRLSDMIVEGKTIWKNPSGYLPGRMAPLLNFYGFMSLAFLVLGIFWFSQYARYWKEVLQLQNCITLVITLGMFEMALWYFDYAEFNESGVRPTGITIWAVTFGTVKRTVSRLIILTVSMGYGVVRPTLGGLTSKVVMLGATFFLASEVLELVEHVGAVSDLSGKAMLFLSLPVAVLDAFFVLWIFTSLSATLNKLQAKRMMAKLDIYRKFTNALAVAVIVSVGWICYELYFKSTDIYNEQWQNAWIIPAFWHVLSFSLLCVICALWAPSQNSMRYAYSDDGSEEFDKEDTLTLIKPSAAAAAVSTKDVSELRSVQIENEDGEEDKRE

SEQ ID NO: 10020 - protein, 504 aa, Cirsium arvense
MDSFTAAILLLLILRVLCIEASVHEYAGDKFTSKGNAFVLHGGSEGIYHSRPKLHQSSATANGDAYIRIERIIFRRPQAVSNFSTGLIYAVIFEVDDRETIGGSAYGGQRAICCTADLAKLGACKEGEIIHRQSIKNPGWPEVFGVSFDVNEETSTMQPRSIQITRTGMYNLYFMHCEPRLSDVIIEGKTIWKNPTGYLPGRMAPLLKFYGFMSIAFLILGSFWFYQYARFWKEVLQLQNCITLVITLGMFEMALWYFDYAEFNKIGVRPTGITVWAVTFGTVKRTVSRMIILTVSMGYGVVRPTLGGLTSKVIMLGATFFTASEVLEVAEHVGAISDLSGKAMLFLSLPVAILDAFFLLWIFTSLSSTLNKLQAKRMMAKLDIYRKFTNALAVAVFVSVGWICYELYFKATDIYNEQWRNAWVIPAFWQVLSFSLLCVICALWAPSQNSMRYAYSDDGSEGFEDDDILMPMKPSPLPTKDVSSPTEVRSSVSDDGDLEEDKTE

SEQ ID NO: 10021 - protein, 285 aa, Solanum tuberosum
MRTSNHLIGLLNFFTFLASIPILGGGIWLSSRANNTDCLKFLQWPLIIIGVSIMVVSLAGFVGACYRNTFLMYIYLWAMFFIIAALIGFVIFAYAVTDKGSGRPVMNREYSEYYLQDYSGWLEERVSSQSYWEKISSCLRDSRGCGKMRRIYNGIPESVEMFYRRKLSPIESGCCKPPTECGYVYQNETVWSPGGGLVGADPDCVKWSNDQEQLCYNCDSCKAGVLASLKKSWRKVSVINIVILILLVIMYMVAIAAFRHNKRIDNDEPYGETRMEKTQPSRIHF

SEQ ID NO: 10022 - protein, 285 aa, Solanum phureja
MRTSNHLIGLLNFFTFLASIPILGGGIWLSSRANNTDCLKFLQWPLIIIGVSIMVVSLAGFVGACFRNTFLMYIYLWAMFFIIAALIGFVIFAYAVTDKGSGRPVMNRAYSEYYLQDYSGWLEERVSSQSYWEKISSCLRDSRGCGKMRRIYNGIPESVEMFYQRKLSPIESGCCKPPTECGYVYQNETEWIPGGGLVGADPDCVKWSNDQEQLCYNCDSCKAGVLASLKKSWRKVSVINIVILILLVIMYMVAIAAFRHNKRIDNDEPYGETRMEKTQPSRIHF

SEQ ID NO: 10023 - protein, 285 aa, Nicotiana tabacum
MRTSNHLIGLLNFFTFLASIPILGGGIWLSSRANNTDCLKFLQWPLIVIGVSIMVVSLAGFAGACYRNTFLMYLYLWAMFFIIAALIGFVIFAYAVTDKGSGRPVLNRVYLEYHLQDYSGWLEERVTSQSYWMKISSCIRDSHVCAKTRRTYNSIPESAEMFYLRKLSPVESGCCKPPTECGYVYQNETVWIPGGGLVGADPDCVNWNNDQGQLCYNCNSCKAGVLASIRKSWRKVSVINIVILIILVIMYMVAIAAFRHNKRIDNDEPYGETRMEKSQPSRIHF

SEQ ID NO: 10024 - protein, 285 aa, Nicotiana benthamiana
MRTSNHLIGLLNFFTFLASIPILGGGIWLSSRANNTDCLKFLQWPLIVIGVSIMVVSLAGFAGACYRNTFLMYLYLWAMFFIIAALIGFVIFAYAVTDKGSGRPVLNRVYLEYHLQDYSGWLEERVTSQSYWMKISSCIRDSHVCAKTRRTYNSTPESAEMFYLRKLSPVESGCCKPPTECGYVYQNETVWIPGGGVVGTDPDCVNWNNDQGQLCYNCNSCKAGVLASIRKSWRKVSVINIVILIILVIMYMVAIAAFRHNKRIDNDEPYGETRMEKSQPSRIHF

SEQ ID NO: 10025 - protein, 285 aa, Nicotiana benthamiana
MRTSNHLIGLLNFFTFLASIPILGGGIWLSSRANNTDCLKFLQWPLIVIGVSIIVVSLAGFAGACYRNTFLMYLYLWAMFFIIAALIGFVIFAYAVTDKGSGRPVLNRVYLEYHLQDYSGWLEERVTSQSYWMKISSCIRDSHVCAKTRRTYNSIPESADMFYLRKLSPVESGCCKPPTECGYVYQNETVWIPGGGLVGTDPDCVNWTNDQGLLCYNCNSCKAGVLASIRKSWRKVSVINIVILIILVIMYMVAIAAFRHNKRIDNDEPYGETRMEKSQPSRIHF

SEQ ID NO: 10026 - protein, 286 aa, Solanum lycopersicum
MRTSNHLIGLVNFLTFLASIPILGGGIWLSSRANNTDCLKFLQWPLIVIGVSIMVVSLAGFAGACYRNTFLMYLYLWAMFFIIAALIGFVIFAYAVTDKGSGRPVMNRVYSEYHLQDYSGWLEERVTSQSYWSKISSCIRDSHVCGKMRRTYNRGIPEPVEMFNLRKLSPLESGCCKPPTECGYTYLNETVWNPGSGIVGSDPDCGRWSNYQQQLCYNCNSCKAGVLASLKKSWRKVSVINIVILIILVIIYMVAIAAFRHNKRIDNDEPYGETRMEKSQPSRIHF

SEQ ID NO: 10027 - protein, 286 aa, Capsicum annuum
MRTSNHLIGLINFFTFLASIPILGGGIWLSSRANNTDCLKFLQWPLIVIGVSIMVVSLAGFAGACYRNTFLMYLYLWSMFFIIAALIGFVIFAYAVTDKGSGRPVMNRVYLEYHLQDYSGWLQERVTSQSYWSKISSCIRDSHVCGKMRRTYNGGIPETVEMFNVRRLSPLESGCCKPPTECGYTYLNETVWNPGGGIVGGDPDCARWSNYQQQLCYNCNSCKAGVLASLKKSWRKVSVINIVILIILVIMYMVAIAAFRHNKRIDNDEPYGETRMEKTQPSRIHF

SEQ ID NO: 10028 - protein, 286 aa, Capsicum annuum
MRTSNHLIGLINFFTFLASIPILGGGIWLSGRANNTDCLKFLQWPLIVIGVSIMVVSLAGFAGACYRNTFLMYLYLWAMFFIIAALIGFVIFAYAVTDKGSGRPVMNRVYLEYHLQDYSGWLQERVTSQSYWSKISSCIRDSHVCGKMRRTYNGGIPETVEMFNVRRLSPLESGCCKPPTECGYTYLNETVWNPGGGIVGGDPDCARWSNYQQQLCYNCNSCKAGVLASLKKSWRKVSVINIVILIILVIMYMVAIAAFRHNKRIDNDEPYGETRMEKTQPSRIHF

SEQ ID NO: 10029 - protein, 286 aa, Solanum phureja
MRTSNHLIGLVNFLTFLASIPILGGGIWLSSRANNTDCLKFLQWPLIVIGVSIMVVSLAGFAGACYRNTFLMYLYLWAMFFIIAALIGFVIFAYAVTDKGSGRPVMNRVYSEYHLEDYSGWLEERVASQSYWSKISSCIRDSHVCGKMRRTYNRGIPEPVQVFNLRRLSPLESGCCKPPTECGYTYLNETVWNPGSGIVGSDPDCGRWSNYQQQLCYNCNSCKAGVLASLKKSWRKVSVINIVILIILVIMYMVAIAAFRHNKRIDNDEPYGETRMEKSQPSRIHF

SEQ ID NO: 10030 - protein, 285 aa, Catharanthus roseus
MRTSNHLIGLLNFLTFLASIPILGGGIWLSSRANNTDCMKFLQWPLIVIGVAIMVVSLAGFAGACYRNTFLMYLYLWAMFFIIAALIGFVIFAYAVTDRGQGRPVLNRVYLEYHLQDYSGWLEERVTSQNYWQKISSCIRDSHVCGKMRKTINGIPEPAEMFYLRKLSPVESGCCKPPTECGYVYQNETVWIPGAGLMGTDPDCARWSNDQELLCFNCDSCKAGVLGSLKKSWRKVSVINIVILIILVIVYVVACAAFRHNKRIDNDEPYGETRMEKAQPSRIHF

SEQ ID NO: 10031 - protein, 286 aa, Nicotiana benthamiana
MRTSNHLIGLVNFFTFLASIPILGGGIWLSSRANNTDCLKFLQWPLIIIGVAIMVVSLAGFAGACYRNTFLMYLYLWAMFFIIAALIGFIIFAYAVTDKGSGRPVMYRGYLEYYLQDYSGWLEERVKSQSYWMKISSCIRGSHVCGKMRRTYNNGIPEPAEMFYRRNLSPLESGCCKPPTECGYTYMNETVWNSGGGLVGGDPDCVRWNNDQQQLCYNCNSCKAGVLASLKKSWRKVSVINIVIVIILVIMYIVAIAAFRHNKQIDNDEPYGETRMEKSRPSSIHF

SEQ ID NO: 10032 - protein, 286 aa, Sesamum indicum
MRTSNHLIGFLNFLTFLLSIPILGGGIWLSSRANNTDCMKFLQWPVIIIGVAIMVVSLAGFAGACYRNNFLMYLYLWAMFFIVAALIGFVIFAYAVTDKGSGQPVLNRVYLDYSLRDYSGTWLADRVASESYWSKISSCIRDSHVCRKMGRTFAGVPESAEMFYLRKLSPIESGCCKPPTSCGFTYINETVWNPGGGLVGSDPDCLRWSNDQEQLCYNCDSCKAGVLASLKKSWRKVSVINIVILILLVILYVVACAAFRHNKRIDNDEPYGETRMEKAQPSRIHF

SEQ ID NO: 10033 - protein, 285 aa, Mimulus guttatus
MRTSNHLIGALNFLTFVLSIPILGGGIWLSSRANNTDCLKFLQWPLIIIGVSIMVVSLAGFAGACYRNNFLMYLYLWAMFIIIATLLGFVIFAYAVTGKGSGQPVMNRAYLDYSLQDYSGWLSDRVASDSYWAKIGSCIRDSRACRKMGRNIGGVPESAEMFYLRKLSPIQSGCCKPPTSCGYVYINETVWTPGGGLVGPDTDCTKWSNDQEQLCYGCDSCKAGVVASLKKSWRKVSVINIVVLIILVILYVVACAAFRHNKRIDNDEPYGETRMEKSQPSRIHF

SEQ ID NO: 10034 - protein, 285 aa, Mimulus guttatus
MRTGNHLIGALNFLTFVLSIPILGGGIWLSSRANNTDCLKFLQWPLIIIGVSIMVVSLAGIAGACYRNNFLMYLYLWAMFIIIATLLGFVIFAYAVTGKGSGQPVMNRAYLDYSLQDYSGWLSDRVASDSYWSKIGSCIRDSRACRKMGRNIGGVPESAEMFYLRKLSPIQSGCCKPPTSCGYVYINETVWTPGGGLVGPDIDCTKWSNDQEQLCYGCDSCKAGVVASLKKSWRKVSVINIVVLIILVILYVVACAAFRHNKRIDNDEPYGETRMEKSQPSRIHF

SEQ ID NO: 10035 - protein, 285 aa, Mimulus guttatus
MRTGNHLIGALNFLTFVLSIPILGGGIWLSSRANNTDCLKFLQWPLIIIGVSIMVVSLAGIAGACYRNNFLMYLYLWAMFIIIATLLGFVIFAYAVTGKGSGQPVMNRAYLDYSLQDYSGWLSDRVASDSYWSKIGSCIRDSHACRKMGRNIGGVPESAEMFYLRKLSPIQSGCCKPPTSCGYVYINETVWTPGGGLVGPDIDCTKWSNDQEQLCYGCDSCKAGVVASLKKSWRKVSVINIVVLIILVILYVVACAAFRHNKRIDNDEPYGETRMEKSQPSRIHF

SEQ ID NO: 10036 - protein, 285 aa, Plantago ovata
MRTSNHLIGILNFLSFLLSIPILGGGIWLSSRANNTDCLRFLQWPLIIIGISIMVVSLAGFAGACYRNTFLMYLYLWVMFFIIATLIGFVIFAYAVTDKGEGQPVINRVYSDYRLQEYSGWLADRVSSPSYWSRISSCIRDSHTCRKLGREIDGFPETAEIFYRRKLSPIESGCCKPPTSCGYTYINETVWSPGGGLIGSDPDCGRWTNDQNQLCYNCDSCKAGVLASLKKSWRKVSVINIVILILLVILYVVAIAAFRHNKRIDNDEPYGETRMEKAQPSRIHF

SEQ ID NO: 10037 - protein, 286 aa, Fraxinus spp
MRTSNHLIGFLNFLTFLLSIPILGGGIWLSSRANNTDCLKFLQWPLIVIGVSIMIVSLAGFAGACYRNTFLMYLYLWAMFFIIAALIGFVIFAYAVTDKGSGRPVMNRAYQEYYLQDYSGWLEERVRSQSYWSKISSCIRDSHICNKMGRTVSGVPETADIFNHRKLNPIESGCCKPPTACGFVYENETYWGQQGGGLGGADPDCVRWNNDQEQLCYSCNSCKAGVLASLKKSWRKVSVVNIVILILLVIIYVIACAAFRHDKRMDNDEAFGETRMEKEQPSRIHF

SEQ ID NO: 10038 - protein, 285 aa, Tabernaemontana elegans
MRTSNHLIGLLNFLTFLASIPILGGGIWLSSRANNTDCMKFLQWPLIVIGVAIMVVSLAGFAGACYRNTFLMYLYLWAMFFIIAALIGFVIFAYAVTDRGQGRPVLNRAYTEYYLQDFSGWLEERVTSQTYWQKISSCIRDSHACARMGRTYNGIPETADMFYLRKLNPIESGCCKPPTECGYIYQNETVWTPGAGLTANNLDCMRWSNDQQSLCYNCNSCKAGVLASLKKSWRKVSVINIVILIILVIVYVVACVAFRHDKRIDNDEPYGETRMEKARPARIQL

SEQ ID NO: 10039 - protein, 285 aa, Amsonia hubrichtii
MRTSNHLVGLLNFLTFLASIPILGGGIWLSSRANNTDCMTFLQWPLIVIGAAIMVVSLAGFAGACYRNTFLMYLYLWAMFFIIAALIGFVIFAYAVTDRGQGRPVLNRVYSEYHLQDYSGWLEERVTSRSYWQKISSCIRDSHVCAKMGRTYNGIPETADTFYLRKLNPVESGCCKPPTQCGNDYQNETFWTAGASLMGTDLDCTKWSNDQQQLCYNCDSCKAGVLASLKKSWRKVSVINIVILVILVIVYVVACAAFRHNKRIDNDEPYGETRMEKSQPSRIHF

SEQ ID NO: 10040 - protein, 285 aa, Ipomoea nil
MRTSNHLIGLMNFLTFLASIPILGGGIWLSSRANSTDCIKFLQWPIIVIGVAIMVVSLAGFAGACYRNTFLMYLYLWAMFFIIAALIGFVIFAYAVTDKGSGRPVMNRAYMEYYLQDYSGWLEERVTTQSYWSKIGSCVRDSHVCGKTRRFVNGAPETADMFYRRHLSPIESGCCKPPTACNYVYMNETLWSTDGGLPAADQDCVRWSNDQQLLCYNCNSCKAGVLGSLKKSWRKVSVINIVVLIFLVIMYVVACAAFRHNKRMDNDESYGETRMEKEHPSRIQF

SEQ ID NO: 10041 - protein, 115 aa, Mimulus guttatus
MRTSNHLIGALNFLTFVLSIPILGGGIWLSSRANNTNCLKFLQWPLIIIGVSIMVVSLAGFAGACYRNNFLMYLYLWAMFIIIATLLGFVIFAYAATGKGSGQSVMNRAYLDYSL

SEQ ID NO: 10042 - protein, 317 aa, Lippia dulcis
MRTSNHLIGFLNFLSFLLSIPILGGGIWLSSRANNTDCMKFLQWPIIIIGVAIMVVSLAGFAGACYRNQFLMYLYLWAMFFIVAALIGFVIFAYAVTDKGSGRPVMNRVYLDYSLHDYSGNWLADRVSSPSYWRKIASCVRDSHTCRKIGRTVGGVPESAELFYLRRLSPIESGCCKPPTSCGFVYINETVWSPGAGLVGSDPDCQRWSNDQDQLCYNCDSCKAGVLASLKKSWRKVSVINIVILIILVILYVVACAAFRHNKRIDNDEPYGETRMEKTHPSRIQLLKEKLELSLKFSRTGVKFYAVLLLSRWNMTS

SEQ ID NO: 10043 - protein, 285 aa, Triphysaria pusilla
MRTSNHLIGFLNFLTFLLSIPILSGGIWLSSRANNTDCMKFLQWPLIVIGVAIMVVSLAGFAGACYRNNFLMYIYLWAMFLIIAALIGFVIFAYAVTDRGSGRPVLNRAYQDYSLQDYSGWLADRVARNSYWYKIGSCIRDSHVCRRIGRNIGGVPEPAEMFYRRRLSPIESGCCKPPTSCGLMYINETVWSPGGGLMGSDPDCSRWSNDQEQLCYGCNSCKAGVLASLKKSWRKVSVINIVILIILVIVYVVACAAFRHNKRADNDEPYGETRMEKSRPSRIHF

SEQ ID NO: 10044 - protein, 286 aa, Fraxinus spp
MRTSNHLIGFLNFLTFLLSIPILGGGIWLSSRANNTDCLKFLQWPLIVIGVSIMIVSLAGFAGACYRNTFLMYLYLWAMFIIIAALIGFVIFAYAVTDKGSGRPVMNRAYQEYNLQDYSGWLEERVKSQSYWSKISSCIRDSHICNKMGRTVSGVPETADIFIRRKLNPIQSGCCKPPTACGFTYENETYWGQQGGGLGGVDSDCVRWNNDQEQLCYSCDSCKAGVLASLKKSWRKVSVVNIVILILLVIIYVIACAAFRHDKRMDNDEDFGETRMEKERPSRIHF

SEQ ID NO: 10045 - protein, 285 aa, Vaccinium corymbosum
MRGSNHLIGLLNFLTFLLSIPILGGGIWLSGRANNTDCLKFLQWPLIIIGVSIMVVSLAGFAGACYRNTFLMYAYLWAMFVIIAVLIGFIIFAYAVTDKGSGHPVANRAYLEYHLDDYSGWLKERVASQTYWEKISSCIRDSKVCWKMGRKIGGVTESADLFYLRKLTPIQSGCCKPPTECGFTYVNETLWNTGGVLAGTDADCTNWSNDQTQLCYSCNSCKAGVLGSLKKSWRKVSVVNIIILIILVIVYMVACAAFRHNRRIDNDEPYGETRMEKARPSRIHF

SEQ ID NO: 10046 - protein, 364 aa, Solanum phureja
ATLSSFRSCSQAQLPLQPTSFPPQFFKKSQFLKSKPLNSAQCYPRLVIAKALGTGDNGDFEDFTATPNKIFMEEAIGAEYGEGFETFRPNGLLKVDVDFLNDRLQEGFLRRIRYAMKPDEAYGLIFSWDNVVADSRALKLDAWNQLASEEGLELPEDDSVQRLLLNATADHILHKALPKEKNEADQDRLKMRLSQLYHDKLLKISEPIEGLKEWLDAVSTARIPCAVVSSFDRRNMVETLERMGLMKYFQAIVTEEDGMESIAHRFLSAAVKLDRKPSKCVVFEDNPRGITAAHNCTMMAVALIGAHPAYDLGQADLAVGTFSELSVINLRRLFAHKGSNFMDLEKQIAEKAPRRRKLTIDTIF

SEQ ID NO: 10047 - protein, 357 aa, Capsicum annuum
TRLLLQLPFQPTSFPPQLPKKFQFFKSKHLNSARCYHRLGVAKALGTGDNEHFGDFPATPNKIFMEEAIGAEYGEGFETFRPNGLLKVDVDFLNDRLQEGFLRRIRYAMKPDEAYGLIFSWDNVVADSRALKLDAWKQLASEEGLEIPEDASVQRFLLYAAADHVLHKVLPRENNEDDRDRLKMRLSQLYYDNLLKISEPIDGLKEWLDALSTARIPCAVVSSLDRRNMVETLERMGLMKYFRAIVTEEDGMESIAHRFLSAAVKLDRKPSKCVVFEDDPRGITAAHNCTMMAVALIGAHPAYDLGQADLAVGSFSELSVINLRRLFAHKGSNFMDLEKKIAEKAPRRRKLTIDTIF

SEQ ID NO: 10048 - protein, 370 aa, Nicotiana benthamiana
MDGTLSFRSCCQAQLPLQPTSFPPQFPSRIQFLRVQKTKPLSSPQCYQSRRMVIRKALWTGDNGHFEDFPVTPNKIFMEEAIGAEYGEGFETFRPNGMLKVDVDFLNDRLQAGFLQRIRYAMKPDEAYGLIFSWDNVVADSGALKLDAWNQLASEEGLEIPEDYNVQRLLLYADADHVLDKVLPREKKEADRDRLKTRLSQLYCDNLLKISEPIEGLKEWLDAVSTARIPCAVVSSLDRRNMVEALERMGLVKYFQAIVTEEDGMESIAHRFLSAAVKLDRKPSKCVVFEDDPRGITAAHNCTMMAVALIGAHPAYDLGQADLAVGSFSELSVINLRRLYAHKGSNFMDLQKQIVEKTPRRRKLTIDTIF

SEQ ID NO: 10049 - protein, 347 aa, Capsicum annuum
PTSFPPQLPKKFQFFKSKHLNSARCYHRLGVAKALGTGDNEHFGDFPATPNKIFMEEAIGAEYGEGFETFRPNGLLKVDVDFLNDRLQEGFLRRIRYAMKPDEAYGLIFSWDNVVADSRALKLDAWKQLASEEGLEIPEDASVQRFLLYAAADHVLHKVLPRENNEDDRDRLKMRLSQLYYDNLLKISEPIDGLKEWLDALSTARIPCAVVSSLDRRNMVETLERMGLMKYFRAIVTEEDGMESIAHRFLSAAVKLDRKPSKCVVFEDDPRGITAAHNCTMMAVALIGAHPAYDLGQADLAVGSFSELSVINLRRLFAHKGSNFMDLEKKIAEKAPRRRKLTIDTIF

SEQ ID NO: 10050 - protein, 292 aa, Solanum tuberosum
CRGDNFNSPFERFGGIMSSIFGFGGRDPFDDPFFSRPSQTSMLHPTTPSDDESNRPVIQEIDTDEDAPLEPDEENGDVNGSKKKRDRAYANRNPLVEHPEDLTDDHSKSSKIISKDVTRGMKDMKLEGTQSKPQSMSYRRVTYGGIDGTYYTATTSRRAGNDGRVLEESKQADSTTGQATHRISRGIQDKGHSLTRKLASDGKVDTMQTLHNLEEDELAGFEQTWNGNANNEIPGWNSGFDFHANAGTSSNWLTNWEAGFRDPFSGVRPSNNSAQSGTQSGRPKKVVRINIE

SEQ ID NO: 10051 - protein, 311 aa, Solanum phureja
CRGDNFNSPFERFGGIMSSIFGFGGRDPFDDPFFSRPSQTSMLHPTTPSDDESNRPVIQEIDTDEDAPLEPDEENGDVNGSKKKRDRAYANRNPLVEHPEDLTDDHSKSSKIISKDVTRGMKDMKLEGTQSKPQSMSYRRVTYGGIDGTYYTATTSRRAGNDGRVLEESKQADSTTGQATHRISRGIQDKGHSLTRKLASDGKVDTMQTLHNLEEDELAGFEQTWNGNANNEIPGWNSGFDFHANAGTSSNWLTNWEAGFRDPFSGVRPSNNSAQSGTQSGRPKKVVRINIEVNVRVHRIDIEPWNGEPPG

SEQ ID NO: 10052 - protein, 478 aa, Solanum phureja
MAGIATAGDTSTSTSSNLAPTRSLSKKENQGLLLGRYEIGKLLGHGTFAKVYHARNVKTNESVAIKVIDKEKILKVGLIDHIKREISILKRVRHPNIVELYEVMATKAKIFFVMEYVKGGELFNKVAKGRLKEEVARKYFQQLISAIAFCHARGVYHRDLKPENILLDEDGNVKVSDFGLSAISEQIKQDGLFHTFCGTPAYVAPEVLGRKGYDAAKVDIWSCGVILFVLMAGYLPFHDQNVMAMYKKIYRGEFRCPRWFSPELTRFLKHLLDINPETRITVQEIMNNRWFKKGFKHVKFYIEDDKLCSINDDEYGGIDYSSDRSESESEIEIRRRSATLPRPASLNAFDIISFSRGFDLSGLFEEGGDGARFVSGAPVPKIINKLEEIAKVVSFAVRKKDCKVSMEGSKEGAKGPLTVAAEIFELTPSLRVVEVKKKGGDSLEYEEFYNRELKPGLQNLAHEVGYPVDSSYLPSDTE

SEQ ID NO: 10053 - protein, 479 aa, Nicotiana tabacum
MAGTTTAGDTSTSSRSNLAPTKSLSKKENQGLLSGRYEIGKLLGHGTFAKVYHARNVKTNESVAIKVIDKEKILKVGLIDHIKREISILRRVRHPNIVQLYEVMATKAKIYFVMEYVKGGELFNKVAKGRLKEEVARKYFQQLISAVAFCHARGVYHRDLKPENILLDEDGNVKVSDFGLSAISEQIKQDGLFHTFCGTPAYVAPEVLARKGYDAAKVDIWPCGVILFVLMAGYLPFHDQNIMAMYKKIYKGEFRCPRWFSPELTKFLRQLLDTNPETRITIQEVMNNRWFKKGFKHVKFYIEDDKLRSVNDDDYDGGVDYSSDRSESESEMEMRRKPATLPRPASLNAFDIISFSRGFDLSGLFEEGGDGARFVSGAPVPKIISKLEEIAKVVSFAVRKKDCRVSLEGSKEGEKGPLTIAAEIFELTPSLRVVEVKKKAGDRVEYEEFYHKELKPGLQNLTLEVDGPVDSSHLPSDTE

SEQ ID NO: 10054 - protein, 508 aa, Nicotiana benthamiana
MAGTTIAGDTSTSSRSNLAPTKSLSKKENQGLLLGRYEIGKLLGHGTFAKVYHARNVKTNESVAIKVIDKEKILKVGLIDHIKREISILRRVRHPNIVQLYEVMATKAKIYFVMEYVKGGELFNKVAKGRLKEEVARKYFQQLISAVAFCHARGVYHRDLKPENILLDEDGNVKVSDFGLSAISEQIKQDGLFHTFCGTPAYVAPEVLARKGYDAAKVDIWSCGVILFVLMAGYLPFHDQNIMAMYKKIYKGEFRCPRWFSPELTRFLRQLLDTNPETRITIQEVMNNRWFKKGFKHVKFYIEDDKLCSVYDDDYDGGVDYSSDRSESESEMEMRRKPATLPRPASLNAFDIISFSRGFDLSGLFEEGGDGARFVSGAPVPKIISRGFDLSGLFEEGGDGARFVSGAPVPKIISKLEEIAKVVSFAVRKKDCRVSLEGSKEGEKGPLTIAAEIFELTPSLRVVEVKKKGGDRVEYEEFYNRELKPGLQNLTLEVGDPIHSSYLPSDTE

SEQ ID NO: 10055 - protein, 353 aa, Lippia dulcis
MAAAAAAPRAATSTSGSKQKEMKGLLLGRYEIGKLLGHGTFAKVYHAKNVKTGESVAIKVIDKEKILKVGLIGHIKREISILRRVRHPNIVQLFEVMATKAKIFFVMEYVRGGELFNKVAKGRLKEEVARKYMQQLISAVAFCHARGVYHRDLKPENILLDEDGNLKVSDFGLSAISEQIKQDGLFHTFCGTPAYVAPEVLARKGYDAAKVDIWSCGVILFVLMAGYLPFHDPNIMAMYKKIYKGEFRCPRWFSPELTRFLTRLLDTNPETRITVTEIMNNKWFKKGFKHVKFYIEDDKLCSVNDDVKDDIDSLSDQSLSESEAELETRRKLTSLPRPASLNAFDIISFSRWF

SEQ ID NO: 10056 - protein, 474 aa, Mimulus guttatus
MAGATGTASTSTSGSHIPTQKEMKGLLLGRYEIGKLLGHGTFAKVYHARNVKTGDSVAIKVIDKEKILKVGLIAHIKREISILRRVRHPNIVQLFEVMATKTKIFFVMEYVRGGELFNKVAKGRLKEEVARKYFQQLISAVSFCHARGVYHRDLKPENILLDEDGNLKVSDFGLSAISEQIKQDGLFHTFCGTPAYVAPEVLARKGYDAAKVDIWSCGVILFVLMAGYLPFHDQNVMAMYKKIYKGEFRCPRWFSPELSRLLTRLLGTNPETRMTIPEIMDNKWFKKGFKHVKFYIEDDKLCNINDDVNYDIGSLSDQSLSESDSELETRRKITTSLPRPASLNAFDIISFSRGFDLSGLFEEGTDGGARFVSGEPVSNIISKLEEIAKVVSFTVRKKDCRVSLEGSRNGVKGPLTIAAEIFELTPSLRVVEVKKKGGDRIEYEEFRDRELKPAMQSLMMGNVAGSSYLPSDTE

SEQ ID NO: 10057 - protein, 467 aa, Amsonia hubrichtii
MDTTTPSATFTKKSISIKKKETQGLLLGRYEIGKLLGHGTFAKVYHAKNIKTNESVAIKIIDKEKVLKIGMIAHIKREISILRRVRHPNIVQLFEVMATKTKIYFVMEYVKGGELFSKVAKGRLKEEAARKYFQQLISAVAFCHARGVYHRDLKPENILLDEDGNLKVSDFGLSAISEQIKQDGLFHTFCGTPAYVAPEVLARRGYDAAKVDIWSCGVILFVLMAGYLPFHDQNIMAMYKKIYKGEFRCPRWFSPELARLLTRLLDTNPETRITIPEIMENRWFKKGFKHVKFYIEDDMLCSVNDDDGIESDQSLSECESEPEMESRRRLASLPRPASLNAFDLISFSRGFDLSGLFEEGGDGARFVSGAPVPKIISKLEEIAKVVSFTVRKKDCRVSMEGSREGVKGPLSIAAEIFELTPSLRVLEVKKKGGDRVEYEDFCNQELKPGLQNLMSEFAADALPSDSE

SEQ ID NO: 10058 - protein, 474 aa, Orobanche aegyptiaca
MAAAAATTTTTTSTNPPKQKEVKGLILGRYEIGKILGHGTFAKVYQARNVKTGDCVAIKVIDKEKILKVGLIAHIKREISILRRVRHPNIVQLFEVMATKSKIFFVMEYVRGGELFSKVAKGRLKEEVARKYFQQLISAVAFCHARGVYHRDLKPENILLDDDGNLKVSDFGLSAISEQIKQDGLFHTFCGTPAYVAPEVLARKGYDAAKVDIWSCGVILFVLMAGYLPFHDQNVMAMYKKIYKGEFRCPRWFSPELVRLLTRSLDTNPETRITIPEIMNNKWFKKGFKHVKFYIEDDKLCSVNDGLGDDDVDSISGQSLSESEAELETRRKIIGLPRPASLNAFDIISFSRGFDLSGLFEEGSDGGARFVSGAPVSNIISKLEEIAKVVSFTVRKKDCRVNLEGTRNGVKGPLTIAAEIFELTPSLRVVEVKKKAGDRLEYEEFRDQELKPGLQSLVIGNVTDTTSYLPSDTE

SEQ ID NO: 10059 - protein, 458 aa, Tabernaemontana elegans
MATAQPITKSISSKKKEMQGLLLGRYEIGKLLGHGTFAKVYHAKNIKTNESVAIKIIDKEKVLKIGMTAHIKREISILRRVRHPNIVQLFEVMATKTRIYFVMEYVKGGELFNKVAKGRLKEEAARKYFQQLISAVAFCHARGVYHRDLKPENILLDEDGNLKVSDFGLSAISEQIKQDGLFHTFCGTPAYVAPEVLARRGYDAAKVDIWSCGVILFVLMAGYLPFNDQNVMAMYKKIYKGEFRCPRWFSPELTRFLTRLLDTNPETRITIPDIMENRWFKKGFKHIKFYIEDDLLCSVNDHEDIESDHSLSECESEPEMESRRRLASLPRPASLNAFDIISFSRGFDLSGLFEEGGDGARFVSGAPVSKIISKLEEIAKVVSFTVRKKDCRVSLEGSRQGVKGPLTIAAEIFELTPSLRVLEVKKKGGDRVEYEDFCNRELKPGLQNLVSEDVADAL

SEQ ID NO: 10060 - protein, 399 aa, Solanum phureja
MDIKFFMFSFILTSLFLILIYMPTQFSHSPITIFKPKKTFIISNTTTNPYPVKFAYLISASKGDVPKLKRLLFSLYHPGNFYLIHLDLDAPENEHQEISRFVSDNSVFGEINNVWVVGKPNLVTYRGPTMLATTLHAMAMLLKIAKWDWFINLSASDYPLVTQDDLIHAFSDLPRDLNFVQHTSHMGWKLNKRGKPIIIDPGLHTLNKSEIWWVIKQRSLPTAFKLYTGSAWTILSRSFAEYCIIGWENLPRTLLLYYTNFVSSPEGYFQTVICNSEEYKNTTVNHDLHYIAWDIPPKQHPRSLGPKDFRRMVLSNRPFARKFKNNNVVLNKIDRDLLRRQNGQYFSAGGWCSNDNDRGCLNLQVEKYGVLKPGTGARRLRTLLKKLVSAPHFAKRQCR

SEQ ID NO: 10061 - protein, 397 aa, Nicotiana benthamiana
MGIKLFMFSFILTSVLFILVYIPTQLSQSPITIFKPTKSFIISNTSKPYPVKFAYLISTSKGDVAKLKRLLFSLYHPGNFYLIHLDLDAPEAEHKEISRFVGGNTVFGEINNVWIVGKPNLVTYRGPTMLATTLHAMSMLLRIAKWDWFINLSASDYPLVTQDDLIHAFSDIPRDLNFVQHTSHMGWKLNKRGKPIIIDPGLHSLNKSEIWWVIKQRSLPTAFKLYTGSAWTILSRSFAEYCIMGWENLPRTLLLYYTNFVSSPEGYFQTVICNSEEYKNTTVNHDLHYITWDNPPRQHPRSLGPKDYRRMVLSNRPFARKFKNNNPVLNKIDRDILRRRNGQFSAGGWCTNDDERGCFSLQGEKYGVLRPGIGARRLKTLLKKLVYAPNFAKRQCR

SEQ ID NO: 10062 - protein, 397 aa, Nicotiana benthamiana
MGIKLFMFSFILTSVLFILVYIPTQLTQSPITIFKPTKSFIISNTSEPYPVKFAYLISASKGDVAKLKRLVFSLYHPGNFYLIHLDLDAPEAELKEISRFVGGNTVFGEINNVWIVGKPNLVTYRGPTMLATTLHAMSMLLRIAKWDWFINLSASDYPLVTQDDLIHAFSDIPRDLNFVQHTSHMGWKLNKRGKLIIIDSGLHSLNKSEIWWVIKQRSLPTAFKLYTGSAWTILSRSFAEYCIIGWENLPRTLLLYYTNFVSSPEGYFQTVICNSEEYKSTTVNHGLHYITWDNPPRQHPRSLGPKDYRRIVLSNRPFARKFKNNNHVLNKIDRDILRRRNGQFSAGGWCSNDDERGCFSLQGEKYGVLRPGTGARRLKTLLKKLVSAPNFAKRQCR

SEQ ID NO: 10063 - protein, 208 aa, Solanum tuberosum
MFKFLFLLAILILSSDAAVQDFCVADFKAPESPSGYSCKSVTNVTVDDFVFSGLSAAGNTASIIKAAVTPAFAAQFPGLNGLGLSAARLDLAAGGVIPFHTHPGASEILLVVQGSITAGFVSSANSVYLKTLKKGDLMVFPQGLLHFQVSDAGYTSVGYVFFSSSNPGLQITDFALFANDLPTKLVGATTFLDEATIKKLKGVLGGTN

SEQ ID NO: 10064 - protein, 208 aa, Solanum phureja
MFKFLFLLAILILSSDAAVQDFCVADLKAPESPSGYSCKSVTNVTVDDFVFSGLSAAGNTASIIKAAVTPAFAAQFPGVNGLGISAARLDLAAGGVIPFHTHPGASEILLVVQGSITAGFVSSANSVYLKTLKKGDLMVFPQGLLHFQVSDAGYTSVGYVFFSSSNPGLQITDFALFANDLPTKLVGATTFLDEATIKKLKGVLGGTN

SEQ ID NO: 10065 - protein, 208 aa, Nicotiana benthamiana
MFKLLFLLAIFILGSNAAVQDFCVADLKGPESPAGYSCKSVANVTVDDFVFSGLSAAGNTASIIKAAVTPAFAAQFPGLNGLGLSAARLDLAPGGVIPFHTHPGASEVLLVVQGSITAGFVSSANAVYLKTLKKGDLMIFPQGLLHFQVSDAGYTSVGFVFFSSSNPGLQITDFALFANDLPTKLVEATTFLDEATIKKLKGVLGGTN

SEQ ID NO: 10066 - protein, 208 aa, Unknown
  Sequence found in Organisms: Nicotiana benthamiana, Nicotiana tabacum
MFKLLFLLAIFILGSNAAVQDFCVADLKGPESPAGYSCKSVANVTVDDFVFSGLSAAGNTASIIKAAVTPAFAAQFPGLNGLGLSAARLDLAPGGVIPFHTHPGASEVLLVVQGSITAGFVSSANAVYLKTLKKGDLMIFPQGLLHFQVSDAGYTSVGFVFFSSSSPGLQITDFALFANDLPTKLVEATTFLDEATIKKLKGVLGGTN

SEQ ID NO: 10067 - protein, 205 aa, Solanum melongena
LVFLLAVVILNSDAAVQDFCVGDLKAPESPSGYSCKSVANVTVDDFVFSGLGAAGNTNSIIKAAVTPAFAAQFPAVNGLGISAGRLDLAAGGVIPMHTHPGASEILLVTQGQITAGFVSSANSVYLKTLKKGDLMVFPQGLLHFQVSAAGYTSVGFVFFSSSNPGLQITDFALFANDLPTKLVAATTFLDEATIKKLKGVLGGTN

SEQ ID NO: 10068 - protein, 203 aa, Capsicum annuum
MSKLIIFLLATLILSSNAAVQDFCVADLKAPESPCGYSCKSVTNVTVDDFVFSGLSAAGNTASIIKAAVTPAFAAQFPGLNGLGLSAARLDLAPGGVIPFHTHPGASEVLLVTQGSITAGFVSSANSVLKKTLKKGDIMIFPQGLLHFQMSHAGYTSVGFVFFSSSNPGLQITDFALFANDLPTKLVGATTFLDEATIKKLKG

SEQ ID NO: 10069 - protein, 208 aa, Nicotiana tabacum
MFKLLFLFALLISSSNAAVQDFCVADLKGPESPAGYSCKTATKVTVNDFVFSGLSAAGNTSNIIKASVTPAFAAQFPGLNGLGLSAARLDLASGGVVPFHTHPGASEVLLVVQGSITAAFVSSANTVYLKTLKKGELMVFPQGLLHFQVNAAGYTSVAYVFFSSSSPGLQITDFALFANDLSTKLVEATTFLDEAQIKKLKGVLGGTG

SEQ ID NO: 10070 - protein, 208 aa, Solanum tuberosum
MFKLLFVFAVLILSSNASVQDFCVADLKGPESPAGYSCKSVTKVTVNDFVFSGLSAAGNTSNIIKASVSPAFAAQFPGLNGLGLSAARLDLAPGGVVPFHTHPGASEVLLVVQGSITAAFVSSANTVYLKTIKKGELMVFPQGLLHFQVNAVGFNSVAYVFFSSSNPGLQITDFALFANDLSTKLVEATTFLDEAQIKKLKGVLGGTG

SEQ ID NO: 10071 - protein, 208 aa, Solanum phureja
MFKLLFVFAVLILSSNASVQDFCVADLKGPESPAGYSCKSVTKVTVNDFVFSGLSAAGDTSNIIKASVSPAFAAQFPGLNGLGLSAARLDLAPGGVVPFHTHPGASEVLLVVQGSITAAFVSSANTVYLKTIKKGELMVFPQGLLHFQVNAVGFNSVAYVFFSSSNPGLQITDFALFANDLSTKLVEATTFLDEAQIKKLKGVLGGTG

SEQ ID NO: 10072 - protein, 76 aa, Solanum tuberosum
MRCFTILFFFSAIVVVALASNVEEVISQVVEIHRLRPQTGSAGYTVPQLDCLSWRLAVETNNSKTGNWCLKNVQTM

SEQ ID NO: 10073 - protein, 184 aa, Solanum phureja
MLGKQYRHDCEYVAKQAIEYAKSLKLSGDGMDVWVFDIDETTLSNSPYYARSDVAFGAIAYNATKFNEWTAEGKLPAIPSILGLYKIVLSLGIKPVFITGTRDNFKQVRIANLKKAGYTNWAALILKGENDSGSAVEFKSRKRTALVKAGYRIVGNIGDQWSDLIGKNVGARTFKLPDPMYYIG

SEQ ID NO: 10074 - protein, 79 aa, Solanum tuberosum
MRSCFTILLLFSAIVAVALASNEEDHQVISQVVEIHRLRPQTGSAGYTVPQLDCLSWRLAVETNNSKTGNWCLKNVQTM

SEQ ID NO: 10075 - protein, 77 aa, Solanum tuberosum
MRSCFTILLLFSAIVAVALASNVEEVISQVVEIHRLRPQTGSAGYTVPQLDCLSWRLAVETNNSNTGNWCLKNVQTM

SEQ ID NO: 10076 - protein, 241 aa, Solanum phureja
MDFSFFGNFPLFKPHSANDMASTVASASTLMQTPKQNAQFWKWTVFSVLPWAKGAEGNIQMPTTVNKKLKRRRPFREGVDSLARTSTIRFRPYVSKVPWHTGPRAFLSQFFPRYGHYCGPNWSSGKDGGSPIWDRRPTDWLDFCCYCHDIGYDSHDQAELLKADLAFLECLEKPNMSTRGDPHAALLYKTMCTSGLRNILIPYRQQLITLQSKQLSFGFGWLGGIMEPAKCLKDRFVWLQK

SEQ ID NO: 10077 - protein, 245 aa, Nicotiana benthamiana
MDFSFLSNFLSFKPHSAKDMASTVVSTSTLIEAPNQKAQFDAKFWKWTLFLFVPWAKGSEGNIQMPTTVNKKLKRRRQSRESVDTLARTSTIRFRPYVSKVPWHTGPRAFLSQFFPRYGHYCGPNWSSGKDGGSLVWDRRPIDWLDFCCYCHDMGYDTHDQAELLKADLAFLECLEKPHMSTRGDPHTALLYKTMCISGLRNILIPYRQRLISLQANQLSFGFGWLSGIMEPAKCLKDRFIWLQK

SEQ ID NO: 10078 - protein, 226 aa, Capsicum annuum
MASTVVSTSTIMKTPKEKAQFDAKFWKWTVFSFVPWAKGAEGNIQMPTTVNKKLKSRRPSRESVDSLARTSTIRFRPYVSKVPWHTGPRAFLSHFFPRYGHYCGPNWSSGKDGGSPIWDRRPIDWLDFCCYCHDMGYDTHDQAELLKADLAFLECLEKPNMSTRGDPHVALLYKTMCISGLRNILIPYRQQLVSLQSQQLSFGFGWLSGIMEPAKCLKDRFIWLQK

SEQ ID NO: 10079 - protein, 174 aa, Solanum phureja
MSFTVTKPSIPSPTLELHPFTKSQLRHCSTSPFGNASRRHQIQRNCGIRVKALPDWPLMAVLVEHMEGQRDLITHKSVWHLSDEAMKNVYTFYIMFTVWGCCFFGSTKDPYYDSEQYRGDGGDGTGHWVYEKQEDIEEEARAELWRDELIEEIEQKVGSLRELEEAGKKEQLVK

SEQ ID NO: 10080 - protein, 153 aa, Solanum tuberosum
MSFTVTKPSIPSPTLELHPFTKSQIRHCSTSPFGNASRRHQIQRNCGIRVKALPDWPLMAVLVEHMEGQRDLITHKSVWHLSDEAMKNVYTFHIMFTVWGCCFLGSTKDPYYDSEQYRGDGGDGTGHWVYEKQEDIEEEARAALWRDELIEEI

SEQ ID NO: 10081 - protein, 141 aa, Solanum melongena
MSFTVVKPFIPSPRLELHPFTKSQLRHSLTHQIQVQRNSCFRVKALPDWPLMAVLVEHMEGQRDLITHKSIWHLSDEAMKNVYTFYIMFTVWGCCFFGSTKDPYYDSEQYRGDGGDVLDIGSMRSKKTLKKEREQSYGVRN

SEQ ID NO: 10082 - protein, 195 aa, Unknown
  Sequence found in Organisms: Solanum tuberosum, Solanum phureja
MAIGMKQMSMIIATLGVLSFIFGVIAENKKPAAGTAISGKGVVICKYKSDPTVALGYLSFVFLAASSVAGFLSLFYPYQGKSVPQAALLRNTSFVVFLNIALGTTGLAATLLLWPTITEQLHITRNIHHNLQTDCPTAKTGLLGGGAFLSLDSALFWLVALMLADNAREDYFQETNVKGEPKASYADDEIIKSSA

SEQ ID NO: 10083 - protein, 195 aa, Solanum melongena
MAIGMKQMSMIIATLGVLSFIFGVIAENKKPAAGTAISGKGVVICKYKSDPTVALGYLSFVFLAASAAAGFLSLFYPYQGKKIPQAALLRNTSFVVFLNIALGTTGLAAALLLWPTISEQLHITHNIHHNLQTDCPTAKTGLLGGGAFLSLDSAFFWLVALMLADNAREDYFQETDVKDELKACYADDETIKTSA

SEQ ID NO: 10084 - protein, 195 aa, Nicotiana tabacum
MAIGMKQMSIIIATLGVLSFVFGVIAENKKPAAGTAIPGKGVVICKYKSDPTVALGYLSFALLVASSVAGFLSLFYPYQGKSIPQAALLKNTSFVVFLNIALGTTGLAAALILWPTISEQLHITRNIHHNLQTDCPTAKTGLLGGGAFLSLDSALFWLVALMLADNAREDYFQDADVKGELKASYADDEVIKSSA

SEQ ID NO: 10085 - protein, 195 aa, Nicotiana benthamiana
MAIGMKQMPIIIATLGVLSFVFGVIAENKKPAAGTPIPGKGVVICKYKSDPTVALGYLSFAFLAVSSMAGFLSLFYPYQGKSIPQAALLKNTSFVVFLNIALGTTGLAAALILWPTISEQLHITRNIHHNLQTDCPTAKTGLLGGGAFLSLDSALFWLVALMLADNAREDYFQDADVKGELKASYADDEIIKSSA

SEQ ID NO: 10086 - protein, 195 aa, Petunia hybrida
MAIGMKHMSMIIATLGVISFIIGVIAENKKPAAGTAIPGKGVVICKYGSDPTVALGYLSFAFLVASSVAGFLSLIYPYQGKSIPQAALLRNSSFLVFFNVALGTTGLTAAFLLWPTITEQLHITRNIHHDLQTDCPTAKTGLLGGGAFLSLDSALFWLVALMLADYARQEYFQEVDDKRELTVSYAADEVIQTSA

SEQ ID NO: 10087 - protein, 135 aa, Unknown
  Sequence found in Organisms: Solanum tuberosum, Solanum phureja
MDGEIKNIKKWNILYPVYINSKKTIAEGRRICVTKACENPTCTEISDCCNFLKIPCAIELDKAYPRDFMQRGRVRVLLKREDGTPYNPVIPSRKQLMINVAELVRRHPNRTKKQEPAASSAAGSSKSGKGGRKKR

SEQ ID NO: 10088 - protein, 135 aa, Solanum melongena
MDGEIKNIKKWNILYPVYINSKKTIAEGRRICVTKACENPTCTEISDCCNFLKIPCAIELDKAYPRDFMQRGRVRFLLKREDGTPYNPVISSRKQLMINVAELVRRHPNRTKKQESAASSAAGSSKSGKGGKKKR

SEQ ID NO: 10089 - protein, 135 aa, Capsicum annuum
MDSEIKNIKKWNILYPVYINSKKTIAEGRRICVTKACENPTVTEISDCCNFLKIPCAIELDKAYPRDFMQRGRVRVLLKREDGTPYNPVISSRKQLMVSVAELVRRHPNRTKKQEPAASSAAGSSKSGKGGKKKR

SEQ ID NO: 10090 - protein, 135 aa, Nicotiana benthamiana
MDSEIKNIKKWNIMYPIYINSKKTIAEGRRICVTKACENPTVTEISDCCNYLKIPCAIELDKAYPRDFMQRGRVRVLLKKEDGTPYNPAISSRKQLMIHVAELVRRHPNRTKKQEPASSSAAGSSKSGKGGKKKR

SEQ ID NO: 10091 - protein, 135 aa, Nicotiana tabacum
  misc_feature (80)..(80): Xaa can be any naturally occurring amino acid
  misc_feature (85)..(85): Xaa can be any naturally occurring amino acid
MDSEIKNIKKWNIMYPIYINSKKTIAEGRRICVTKACENPTVTEISDCCNYLKIPCAIELDKAYPRDFMQRGRVRVLLKXEDGTXYNPAISSRKQLMIHVAELVRRHPNRTKKQEPASSSAAGSSKSGKGGKKKR

SEQ ID NO: 10092 - protein, 135 aa, Nicotiana benthamiana
MDSEIKNIKKWNIMYPIYINSKKTIAEGRRICVTKACENPTVTEISDCCNYLKIPCAIELDKAYPRDFMQRGRVRVLLKKEDGTTYNPAISSRKQLMIHVAELVRKHPNRTKKQEPASSSAAGSSKSGKGGKKKR

SEQ ID NO: 10093 - protein, 68 aa, Petunia hybrida
MQRGRVRVLLKREDGTPYNPAISSRKQLMVQVAELVRRHPSRTRKQEPASTSSAAGSSKSGKGGKKKR

SEQ ID NO: 10094 - protein, 135 aa, Ipomoea nil
MDGNIQNIKKWIVFYPIYINSKKTIAEGRRISVSKACENPTCAEIQDCCNHLKIPSAIEIDKAYPRDFMQRGRVRVLLKKEDGTLYNPAISSRKQLMIHVAELVPRHPNRTKKQEPASSSAAGPSKSGKGGKKRR

SEQ ID NO: 10095 - protein, 135 aa, Amsonia hubrichtii
MDGDIKNIKKWIVIYPVYINSKKTIAEGRRINVNKACENPTCAEIHDCCNYLKLPCAIEIDKAYPRDFMQRGRVRVQLKKEDGSFCNPAISSRKQLMMQVAELVPRHPGRTKKQEPASSSAAGPSKSGKGGKKKR

SEQ ID NO: 10096 - protein, 135 aa, Ipomoea batatas
MDGSAQNIKKWIVFYPIYINSKKTIAEGRRICVSKACENPTCAEIQDCCNHLKVPSAIEIDKAYPRDFMQRGRVRVLLKKEDGTLYNPAISSRKQLMIHVAELVPRHPNRTKKQEPASSSTAGPSKSGKGGKKRR

SEQ ID NO: 10097 - protein, 80 aa, Catharanthus roseus
MDGDIKNIKKWIVIYPVYINSKKTIAEGRRINVSKACENPTCAEIHDCCLHLKLPSAIELDKAYPRDFMQRGRVRVQLEK

SEQ ID NO: 10098 - protein, 136 aa, Ricinus communis
MADGSIPNIKKWVVLYPVYINSKKTIAQGRRICTTKACENPTCVEIGDCCSHLKLPFAIEIDKAYPRDFMQIGRVRVLLKREDGTLYNPAIPTRKQLMLHVAELVPRHPGRTKKQESASTSNAGTSKSGKGGKKKR

SEQ ID NO: 10099 - protein, 348 aa, Unknown
  Sequence found in Organisms: Solanum tuberosum, Solanum phureja
MGGGEEDQQKLKNTAAAAYDYENDPRWADYWSNILIPPHMASRSDVVDHFKRKFYQRYIDPGLVVEPMTTSSSSQSARPSAAQPSSSSSSTPSNNQPRQRNSGQASRTSGTSTNPTSNPTSLRWDRKTIQFSVNAWVFVVAVLSIFPLTPANLSNRAYRLSFLGTACSSLYSLYSVYGKPRAWNLQAVQVWLQSVIVTKDFISFIYCLTFVTSHLYLKFSLIPVICRSLDHVGKFLRRNFSRSSLYRKYLEEACVWVESNVTTLNILSSQAEIGLGFLLVVSLLSWQRNIIQTFMYWQILKLMYHAPATAGYHQSVWAKIGGFVNPVVQRYVPFLNTPISTIQRWWFR

SEQ ID NO: 10100 - protein, 349 aa, Capsicum annuum
MGGGDEDQQKLKSVAAAAYDYENDPRWADYWSNILIPPHMASRPDVVDHFKRKFYQRYIDPGLVVEPMTTSSSSQSARPSAAQPSSSSSSSTTSSNQPRQRNSGQASRTSGTSTTPASNPTSLRWDRKTIQFSVNAWVFVVAVLSIFPLTPTNLSNRAYRLSFLGTACSSLYALYSVYGKPRAWNLQAVQAWLQTVIVTNDFIYFIYCLTFVTSHLYLKFSLIPVLCRALDHVAKFLRRNFSRSSLYRKYLEEACVWVESNVTTLNILSSQAEIGVGFLLVVSLLSWQRNIIQTFMYWQILKLMYHAPATASYHQSAWSKIGMLVNPLVQRYAPFLNTPISTIQRWWFR

SEQ ID NO: 10101 - protein, 347 aa, Nicotiana benthamiana
MGEGGEDPQKLKKVAAAAYDYENDPRWADYWSNILIPPHMASRSDVVDHFKRKFYQKYIDPGLVVEPMTTSNSSQPARPSPAQPSSSSSTTSNNQPRQRNSGPASRTSGTSSTPASNPTSLRWDRHTIQFSVNAWVFVVAVLAVFPLTPTILSNRAYRLSFLGTACSSLYSLYSLYGKPRAWNLQAVQVWLQSVIVTKDFIYFIYCLTFVTSHLYLKFALIPVSCRALEHVVKFLRRNFSTSSLYRKYLEEACVWVESNVTTLSILSSQAEIGLGFLLVVSLLSWQRNIIQTFMYWQLLKLMYHAPATAGYHQSAWAKIGRLVNPLVQRYAPFMNTPISTIQRWWFR

SEQ ID NO: 10102 - protein, 347 aa, Nicotiana benthamiana
MGEGGEDPQKLKKIAAAAYDYENDPRWADYWSNILIPPHMASRSDVVDHFKRKFYQKYIDPGLVVEPMTTSNSSQQARPSPSQPSSSSSTTSNNQPTQHNSGPASRTSGTSSTPASNPTSLRWDRHTIQFSVNAWVFVVAVLAVFPLTPTILSNRAYRLSFLGTACSSLYSLYSLYGKPRAWNLQAVQVWLQSVIVTKDFIYFIYCLTFVTSHLYLKFALIPVSCRALEHVAKFLRRNFSTSSLYRKYLEEACVWVESNVTTLSILSSQAEIGLGFLLVVSLLSWQRNIIQTFMYWQLLKLMYHAPATAGYHQSAWAKIGRLVNPLVQRYAPFMNTPISTIQRWWFR

SEQ ID NO: 10103 - protein, 347 aa, Solanum phureja
MGEEAEDPQKLKKIAAAAYDYENDPRWADYWSNILIPPHMGSRSDVVDHFKRKFYHRYIDPGLVVEPMTTSSSSQSARSSAPQSSSSSTSNNQPRQRNSGAANRTSGTSPTPTPTSSATSLRWNRQTIQFSVNAWVLVVAVLAIFPLIPTNLSNRAYRLAFAGTACSSLYSLYALYGKPSAWNLQALQVWLQSVIMAKDFLYFIYCLTFVTSHLSLKFALIPVICRGLEHVAKFLRRNFNTSSLYRKFLEEACVWVESNTTTLSILSSQAEIGLGLLLVVSLFSWQRNILQTFMYWQLLKLMYHAPATAGYHQSMWATIGRHVNPLVQRYAPFMHTPISSIQRWWLR

SEQ ID NO: 10104 - protein, 343 aa, Solanum phureja
MDKEAGNHHHHQNQNHGISNKDEFSPRIKPPQNYHVATGNSDRLKRDEWSEGAVSCLLEAYEAKWILRNRAKLKGQDWEDVAKHVSARVNSTKSPKTQTQCKNKIESMKKRYRSESATAADASSWPLYPRLDLLLRGNNASAASSSLIPPPLPPAAPPNTNCVIDAVEPTQPPIVLPPPPPPLPPSPALPIGNGDQNSHGSNGLDRGIKEDILMDAKLSDNAAAADHKNATATNSSSTPALYSDNKSKSKLRSKNKRKRAVEGWEIGESIRLLAEVVVRSEQARMETMRDIERMRAEAEAKRGEMDLKRTEIIANTQLEIAKLFASITKGSVDSSLRIGRSSS

SEQ ID NO: 10105 - protein, 343 aa, Solanum tuberosum
MDKEAGNHHHHQNQNHGISNKDEFSPRIKPPQNYHVATGNSDRLKRDEWSEGAVSCLLEAYEAKWILRNRAKLKGQDWEDVAKHVSARVNSTKSPKTQTQCKNKIESMKKRYRSESATAADASSWPLYPRLDLLLRGNNASAASSSLIPPPLPPAAPPNTNCVIDAVEPTQPPIVLPPPPPPLPPSPALPIGNGDQNSHGSNGLDRGIKEDILMDAKLSDNAAAADHKNATATNSSSTPALYSDNKSKSKLRSKNKRKRAMEGWEIGESIRLLAEVVVRSEQARMETMRDIERMRAEAEAKRGEMDLKRTEIIANTQLEIAKLFASITKGSVDSSLRIGRSSS

SEQ ID NO: 10106 - protein, 188 aa, Solanum phureja
MLGRRFISFLRRTPSSSGKVVAEEGKAKTWGRRIVSGTLICLTGGVALSALDDLSIYHSCSSKALERASKNKPIIDAIGEPIVRGPWYNASLAVAHQRQSVSCTFPVSGPQGTGIFQLKAVRNGEDKWSFLRASDWEILIMEALVHVPGNEEKQQTFRIKVSDDLPPPASNACTDCIPQEPSGNVDKK

SEQ ID NO: 10107 - protein, 175 aa, Solanum tuberosum
SASGKVVAEERKAKTWGRRIVSGTLICLTGGVALSALDDLSIYHSCSSKALERASKNKPIIDAIGEPIVRGPWYNASLAVAHQRQSVSCTFPVSGPQGTGIFQLKAVRNGEDKWSSFLRASDWEILIMEALVHVPGNEEKQQTFRIKVSDDLPPPASNACTDCIPQEPSGNVDKK

SEQ ID NO: 10108 - protein, 188 aa, Nicotiana benthamiana
MLGRRFISFLRRNPSPSEKVVAEEGKAKTWGRRIVSGTLICLTGGVALSALDDLSIYHSCSSKALEKASKNKTILHAIGEPIVRGPWYNASLAVAHQRHSVSCTFPVSGPRGTGIFQLKAVRNGEDNWSSFLRPSDWEILIMEALVHVPGSEEKQQTFRIRISDDLPPPASNACTDGTSQESCSVEKK

SEQ ID NO: 10109 - protein, 171 aa, Nicotiana tabacum
EKVVAEEGKAKTWGRRIVSGTLICLTGGVALSALDDLSIYHSCSSKALEKASKNKTIIDAIGEPIVRGPWYNASLAVAHQRHSVSCTFPVSGPQGTGIFQLKAVRNGEEKWSSFLRPSDWEILIMEALVHVPGNEEKQQTFRIRVSDDLPPPASNSSTDCTSQESCSVEKK

SEQ ID NO: 10110 - protein, 529 aa, Solanum phureja
MANNAAACAERATSDMLIGPDWAINIELCDIINMNPGQAKDALKIIKKRLGSKNPKIQLLTLFVLETLSKNCGENVFQQIVEREILRDMVKIVKKKPDLNVREKILILIDSWQEALGGPGGRFPQYYAAYNELKAAGVEFPPREENSVPLFTPPQTHPIVHMPSAYEEAAVEASLESDPSGLSVAEIQSAEGLSDVLTEMLGALDPKNPQSVKEEVIVDLVEQCRSYQKRVMILVNNTVDEDLLCKGLALNDTLQRVLRRHDDIAKGTSTITVPPRETPVAPLMNVNHEDDESEDDFSHLSRRTSRDPSQGQGRKTIDVKSEPMRITPTLPPPPSSRRPVFTDGKMVDYLSGDRFESERSLGTEGSSPIAASTNSNNASSIPWSSPKPSSSAPPPDDLLNPTADEDFLNPTASMFTGKNNHNESNSKAKSADNLPPAPWDAPPPTALPPPPARYDQRQQYFEKHVSGGSPPAKTGSTSYDNIVGQTKNLSINSSSPSKPEKPEDALFKDLVDFAKAKSSSSSNQSNRSF

SEQ ID NO: 10111 - protein, 528 aa, Capsicum annuum
MANNAAACAERATSDMLIGPDWAINIELCDIINMNPGQAKDALKIIKKRLGSKNPKIQLLTLFVLETLSKNCGENVFQQIVERDILKDMVKIVKKRPDLNVREKILILIDSWQEALGGPGERFPQYYAAYNELKAAGVEFPPREENSVPLFTPPQTHPIVHAPSAYEEAAVEASLESDPSGLSVAEIQNAEGLADVLTEMLGALDPKNLQSVKEEVIVDLVEQCRSYQKRVMILVNNTVDEDLLCKGLALNDNLQRVLLRHDDIAKGTSTSIVPPRETHVAPLMNVNHEDDESEDDFSHLARRSSRDPSQGQGRRAIDVKNEPMRITPTLPPPPSSRRPVFTEGKMVDYLSGDRFESERSLGTEGSSSIAASTNSNSANSIPHSSPKSSLSAPPPDDLLNPTADDDFLNPTASMFTGKSNHNESDKKAKSADHLPPVPWDAPPATLPPPPARYDQRQQYFEKHVSGGSPPQRTGSSSYDGLVGQTKNLSINSSSPSKPEKPEDALFKDLVDFAKAKSSPSSNQSNRSF

SEQ ID NO: 10112 - protein, 515 aa, Nicotiana benthamiana
MANNAAACAERATSDMLIGPDWAINIELCDIINMNPGQAKDALKIIKKRLGSKNPKIQLLTLFVLETLSKNCGENVFQQIVERDILKDMVKIVKKKPDLNVREKILILIDSWQEALGGPGGRFPQYYAAYNELKAYGVEFPPREENSVPLFTPPQTQPIVHMPSAYEEAAVEASLESDPSGLSVSEIQTAEGLADVLTEMLGALDPKNPQAVKEEVIVDLVEQCRAYQKRVMILVNNTVDEDLLCKGLALNDGLQRVLRRHDDIANGTSTITVQPRETPIAPLMNVNHEDDESEDDFSHLARRSSKDPSQAQGRKTVDVKSEPMRITPTLAPPPSSRRPVSTDAGMVDYLSGERFESERSFGTAGSSPIAVSTNSNNVSSIPRSSPPSDDLLNPTADDDFVNPTASLFTGKSNNGESDTKAKSADHLPPAPWDAPPTTLPPPPARYNQRQQYFEKNVFGGGSSSYDSVVGQTKNLSINSSSPSKQEKPEDALFKDLVDFAKAKSSSSSNQSNRSF

SEQ ID NO: 10113 - protein, 130 aa, Solanum tuberosum
MDMPKGDKLVLRGLKFHGYHGVKQEERKLGQKFLVDVDAWMDLRPAGESDCLSDTLSYTDIYRIVKEVMEGPPKNLLESVAQLIASTTLTKYPQVSAVRVQVGKPHVAVQGPVDYLGVEIIRYRDLDVQN

SEQ ID NO: 10114 - protein, 130 aa, Solanum phureja
MDMPKGDKLVLRGLKFHGYHGVKQEERKLGQKFLVDVDAWMDLRPAGESDCLSDTLSYTDIYRIVKEVMEGSPKNLLESVAQLIASTTLTKYPQVSAVRVQVGKPHVAVQGPVDYLGVEIIRYRDLGVQN

SEQ ID NO: 10115 - protein, 126 aa, Solanum melongena
MDMPTGDKLVLRGLKFHGYHGVKQEERKLGQKFLVDVDAWMDLRPAGASDCLCDTLSYTDIYRIVKEVMEGPPKNLLESVAQLIASTTLTKYPWVSAVRVQVGKPHVAVQGPVDYLGVEIIRYRDR

SEQ ID NO: 10116 - protein, 126 aa, Capsicum annuum
MDIPKGDKLVLRGLKFHGYHGVKPEETKLGQKFLVDVDAWMDLRPAGKSDCLSDTLSYTDIYRIVKEIVEGPPRKLLENVAELIASTTLNKYPQVSAVRVQVGKPHVAVQGPVDYLGVEIIRHRDL

SEQ ID NO: 10117 - protein, 128 aa, Nicotiana benthamiana
MDIPKGDKLVLRGLKFHGYHGVKPEETKLGQKFLVDVDAWMDLRPAGKSDCLSDTLSYTDIYKIVKEIVEGPPRKLLEKVAELIASTTLDKYPQVSAVRVQVGKPHVAVQGSVDYLGVEIIRHRDLDG

SEQ ID NO: 10118 - protein, 115 aa, Nicotiana benthamiana
MDIPKGDKLVLRGVKFHGYHGVKPEETKLGQKFLVDVDAWMDLRPAGKSDCLSDTLSYTDIYKIVKEIVEGPPRKLLEKVAELIASTTLDKYPQVSAVRVQVGSRMWLFKDLLTT

SEQ ID NO: 10119 - protein, 141 aa, Nicotiana tabacum
  misc_feature (69)..(69): Xaa can be any naturally occurring amino acid
  misc_feature (76)..(76): Xaa can be any naturally occurring amino acid
  misc_feature (86)..(86): Xaa can be any naturally occurring amino acid
HGITQHQGSVTGHMDIPKGDKLVLRGLKFHGYHGVKPEETKLGQKFLVDVDAWMDLRPAGKSDCLSDTXSYTDIYXIVKEIVEGPXRKLLEKVAELIASITLDKYPQVSAVRVQVGKPHVAVQGSVDYLGVEIIRHRGLDG

SEQ ID NO: 10120 - protein, 124 aa, Capsicum annuum
HEEGDKLVLRGLKFHGYHGVKPEETKLGQKFLVDVDAWMDLRPAGKSDCLSDTLSYTDIYRIVKEIVEGPPRKLLENVAELIASTTLNKYPQVSAVRVQVGKPHVAVQGPVDYLGVEIIRHRDL

SEQ ID NO: 10121 - protein, 142 aa, Olea europaea
MSSSGTVQVTDHQEMLNGDKLVLRGLKFHGYHGVKPEERKLGQKFLIDVDAWMDLRVAGNSDNLSDTISYTAIYRIVKEVVEGASQNLLESVAQLIASTILSNYHQVSAVRVQVGKPHVAVQGPVDYLGVEITRYRSVDMQS

SEQ ID NO: 10122 - protein, 665 aa, Vitis vinifera
MALNIESFTGCDQICTEPLAATPFGSPCGCVFPMKVRLLLDVALYAVFPVVAELAIEVAAGTYLEQSQVKIVGASADSQNQGKTVVDINLVPLGEKFDNTTAMLTCERFWQKKVPLNRTLFGNYDVLYINYPGIPSSPPSGSYMGSGPSGSAGGLPITADFVNKSQKLNPRTIAIIALSGFVLVLVCIGAISIVLKWRKIGRPSSAVGPVFTSSINKRSGIGSMLSSSIASSTSASLISTMATCVLSVKTFPLAELEKATHKFSSKRILGEGGFGRVYHGTMEDGTEVAVKLLTRDHQSGDREFIAEVEMLSRLHHRNLVKLIGICIEGHTRCLVYELVHNGSVESHLHGADKGKGPLDWDARMKIALGAARGLAYLHEDSNPRVIHRDFKASNVLLEDDFTPKVSDFGLAREATEGSHHISTRVMGTFGYVAPEYAMTGHLLVKSDVYSYGVVLLELLSGRKPVDMSQPPGQENLVTWARPLLTVREGLEQLVDPSLAGNYDFDNVAKVAAIASMCVHPEVTHRPFMGEVVQALKLIYNDKDETCGDCCSQKESSGPDSDLRGDLDPSDSSWWNAGGITPRLTYGHATPFITMEYSSGPLEETENRPFSASSLVGEGASLQITHGNRSGPLRTIRSKPGFYRLKGSMSEHGVLSKRVWNDGAWV

SEQ ID NO: 10123 - protein, 142 aa, Olea europaea
MSSSGTVQVTDHQEMLNGDKLVLRGLKFHGYHGVKPEERKLGQKFLIDVDAWMDLRVAGNSDNLSDTISYTAIYRIVKEVVEGASQNLLESVAQLIASTILSNYHQVSAVRVQVGKPHVAVQGPVDYLGVEITRYRSIDLQS

SEQ ID NO: 10124 - protein, 131 aa, Antirrhinum majus
CGEMIKGDKLVLRGLKFHGYHGVKPEERTLGQKFLIDVDAWMDLRPAGDSDLLTDTISYTAIYGIVKEVVEGTPRNLLESVAQLIASTVLSKYTQVSAVRVQVGKPHVAVVGPVDYLGVEIIRYRTVDAQA

SEQ ID NO: 10125 - protein, 133 aa, Quercus alba
MENVAIVKGDKLILRGLKFHGYHGVKPEERKLGQKFLVDVDAWLDLQPAGKSDCLSDTVSYTDIYRIVKEVVEGPAHNLLESVAQLIASTTFTKHPQISAVRVVVGKPHVAVPGSVDYLGVEILRYRSVDASN

SEQ ID NO: 10126 - protein, 673 aa, Solanum phureja
MKSLPGAPFKGISEDIRGRVSCYKQDWIAGIRSGIGILAPTTYIFFASALPVIAFGEQLSRETDGSLSTVETLASTAICGIIHSILGGQPLMILGVAEPTIIMYSYLYKFAKGREELGQTLYLAWAGWVCVWTALMLFLLAIFNACSIISKFTRIAGETFGMLIAVLFIQEAIKGLVSEFSIPKAEDPSSEKYQFHWLYTNGLLGIIFTFGLLYTALKSRKARSWWYGTGWIRSFIADYGVPLMVLMWSALSFIVPSNVPSGVPRTLYSPLPWESASLYHWTVIKDMVKVPPVYIFAAIIPAVMIAGLYFFDHSVASQMAQQKEFNLKNPSAYHYDILLLGFMTLLCGLLGLPPSNGVLPQSPMHTKSLAILKKQLIRKKMVESAKESIRRKASNSEIYGNMQAVFIEIDSSPISAVAKELEHLKEAIMKGESENANGEKSNGIFDPEKYIDAYLPVRVNEQRVSNLLQSLLVAASVGAMPVIKKIPTSVLWGYFAYMAIDSLPGNQLWERTLLLFVAPGRRFKVLEGVHASFVESVPFRYIAIFTIFQFMYLLLVFGVTWIPIAGILFPLPFFLLISIRQHLLPKLLHPRHLQELDAAEYEEIAGAPQRALSISFRETETTLPRTEGAIEICDAEILDELTTSRGEFKVRTVSFSEDKRPQVIHPTADTESE

SEQ ID NO: 10127 - protein, 668 aa, Solanum phureja
GMKSFFTSPFRGITDDFRGRASCYKHDWIAGFAILAPTTYIFFASALPVIAFGEQLSRDTDGSVSTVETLASTAICGIIHSIFGGQPLLILGVAEPTIIMYTYMYKFAKGRQELGQSLYLAWAGWVCVWTALLLVLLAIFNACYIINRFTRIAGETFGMLISLLFIQEAIKGLVSEFKVPKAEDSSLEKYQFQWLYINGLLGVIFSFGLLYTSLKSRKARSWWYGTGWFRSFVADYGVPLMVLVWSALSYGVPSEVPSGVPRRLFSPLPWESASSHHWTVIKDMGKVPPTYIVAALIPALMIAGLYFFDHTVASQMAQQSEFNLKNPSAYHHDILLLGFMTLLCGLIGVPPSNGVLPQSPMHTKSLAVLKRQLIRRKMVKSAKESIKRKASNSEIYGNMQAVLIEIDSSSDTTVAKELEHLKEAVMKSTENKNGGTTEVTFDPEKHIDVYLPVRVNEQRVSNLLQSLLVAASVFAMPVIKKIPTSVLWGYFAYMAIDSLPGNQLWERLLLLFITTGRRFKVLEGVHASFVESVPFRYIAIFTIFQFVYLLLCFGVTWIPIVGILFPLPFFLLLSIRQHILPKLFQPHHLRELDAAEYEEIVGASQRLRSFSSKEKEVPTNGTHEEGEVDICNAEILDELTTSRGEFKVRSKSFSEDKRPQVHATRDTI

SEQ ID NO: 10128 - protein, 81 aa, Avena sativa
MKLQVAAVASLLLVTLAATAGAVTFDASNTASARGRPAVQPGRRPRILEAGPLRRIHLHLEHLQPARRLRPQARERRHPHR

SEQ ID NO: 10129 - protein, 226 aa, Secale cereale
MKLQVATVAFFLLVTMAAPARAVTFDASNTASGTTGGQRFDQAVGLAYSKQVLSDASTFIWSTFNQRAAADRKPVDAVTLVVEDIDGVAFTSANGIHLSASYVGGYTSGDVRKEVTGVLYHEATHVWQWNGQGAANGGLIEGIADYVRLKAGLAPGHWRPRGSGGRWDEGYDITARFLDYCGSLKPGFVAQLNAKMKSGYSDDFFAQILGKNVQQLWQEYKAKFGG

SEQ ID NO: 10130 - protein, 227 aa, Panicum virgatum
MKLDVATFASLLALAAAASAAGAVTFDATNTASSTPGGRRFDQAVGLGYAKRVLSDASTFIWSTFNQRSAAGRKPVDAVTLVVEDIDGVAFTSANGIHLSARYVGGYSSGDVQAEVTGVLYHEATHVWQWDGRGRANGGLIEGIADYVRLKAGYAPGHWVKPGQGDRWDQGYDVTARFLDYCDSLKPGFVALLNAKMKDGYSDDFFAQITGKSVQQLWQDYKKKYGG

SEQ ID NO: 10131 - protein, 194 aa, Triticum aestivum
MHALREIRKEKMDGVVVFADENGILRTELFDEAQKVKSVGAVPVGILGEDEGTKESFLQAPACDEAGKLVGYHVSEETLLPAARSDMLLSTRLEWAGFVVNARVLWESASERPEWVRDLDAVDGGAHLDSPLGLVTDAGQVEPLARCAQAALAWSLRSDALHEVKFPHEWKFDAPLVSAASRQQSSVVNTEDGH

SEQ ID NO: 10132 - protein, 438 aa, Avena sativa
EEISLCSLRRHEAPAVGGVAGHGTRAGQAVAAHHLAHPARAILRHLHGSRLPLLAPRRLPPLPPGPAHEPGRAPRLPRHAARHARQLQRHRHHHHHHNHNNHSHHHHHGGRDRGLRQRAPPGPPRPRLRRPPRHTRPQVAAPGPHRAPQGAPHPRSSPERAAQHSRRGSGPPRPVIAITPTTTSALQAPSLTSLAHTLRLVDARSCGSSSSLGHRTDAVADVLSRSTLEFLHLTGPVEASTAHLRMHALREIRKQRMDGVVVFADENGILRTELFDEAQKVKSVGAVPVGVLGEDEGTKESFLQAPACDAEGKLVGYHVSEETLLPAERSDMLLQSRLEWAGFVLDARVLWEGAAERPEWVRDLDTVDGAAHLESPLALVTDAGRVEPLAGCGQAALAWSLRSDALREVKFPHEWKFDAPLVNAASRQLGVVNTEDGH

SEQ ID NO: 10133 - protein, 429 aa, Brachypodium distachyon
MKLPLSAGSPDAAALPESASKPSLPATWLILHALFCATSMAVGFRFSRLVVFLLFLPTPPMDPAAHLVSLVSPPVMLASANATAATITTTTTTTTTVTTTTTVAEAHHDHGHVHHGPVFVGRHAIRVRSWPHPDPAELIKAHHILAAVQDAQRSSRRRGAEPVRPVIAVTPTATSALQAPCLTSLAHTLRIVDGPLLWIVAEPGHRTDAVAAVLSRSGLDFLHLAGPAGASTARLRMHALREIRKQRMDGVVVFADENGILRTELFDEAQKVKSVGAVPVGILGEDEGTKESFLQGPACDDAGKLVGYHVSEETLLPAERGDMLLSSRLEWAGFVLNARVLWEGAPERPDWVRDLDAVDGAAHLDSPLALVTDAARVEPLAKCAQAALAWSLRSDALHEVKFPHEWKFDPPLVNAASRQQSVVNTEDGH

SEQ ID NO: 10134 - protein, 714 aa, Secale cereale
MAALAATALVGLLLALAPVVGADTDAAGVAALGDLYTSWNSPAQLVGWSAAGGGDPCGAAWMGVSCSGSAITSINLSGMGLNGTLGYLLSSLVALTTMDLSNNSLHDVIPYQLPANLIHLNLARNNFSGNLPYSISNILSLGYLNLSHNSLFQEIGELFGGLNSLSVLDLSFNNLSGNLPVSFVSLSNLSSLYMQNNQLSGTVNVLSNLSLTTLNIANNNFSGLIPGELSSIPDLSAGGNSFINMPASPPPVIMPPSQSPVAQPDRPQVPTTFPNGPEEDIPIDEGDKKQGRQTGLLVGLAVGSVAAASCILFALVFCLHSVHKRKDGGTGEPKDFVGALAVNIDRDSNNNIHQDSPVAASVLQRPIGTPERAYGVNSSPAKKIKVPGAATSYTVASLQVATNSFCQDTLLGEGSLGRVYRADFPNGKVLAVKKIDSAALSLYEEDHFLEVVSNISRLRHPNIVSLTGYCADHGQRLLVYEHIGNGTLHEMLHFSDEASKSLTWNARVRIALGTARALEYLHEVCLPPVVHRNLKSSNILLDEEYSPHLSDSGLAAFSPNPEREVSTEVLGSLGYSAPEFAMSGTHTVKSDVYSFGVVMLELLTGRKPLDRSRERSEQSLVGWATPQLHDIDALAKMVDPAMDGMYPAKSLSRFADIIALSVQPEPEFRPPISEVVQQLVRLMQRASMLRRQSGDDLGSSYRAPEREGGASDAV

SEQ ID NO: 10135 - protein, 720 aa, Brachypodium distachyon
MAAPAADAALAGLLLALVTVVGADTDAADVAALVNLYTSWNSPAQLTGWSAGGGDPCGAAWMGVSCSGSAITSINLSGMGLNGTLGYQLSDLVALKTMDLSNNNLHDAIPYQLPPNLTYLSLASNNFSGNLPYSISNMLSLVYLNLSHNSLFQEIGELFGNLNSLSELDVSFNNMSGNLPMSFISLSNLSSLYMQNNQLSGTVNVLSNLSLTTLNIANNNFSGLIPGELSSIPNLTLGGNSFINMPASPPPTLMPPPQSPLDQPEYPQAPISFPDRPQIPNNQGRKKQGLQTGRLIGVVVGSIAAGSCILFVLVFCLHNVHRRKDGGSSESKDHVGSLAVNIDRGSNREILDKSHQDASVATSTLPQPTGKMTPERVYGTNGSPAKKIKVPSAATSYTVASLQVATNSFCQDSLLGEGSLGRVYRADFPNGKVLALKKIDSAALSLYEEDHFLEVVSNISRLRHPNIVSLTGYCVEHGQRLLVYQYIGNGTLHDLLHFSEEASKNLTWNARVRIVLGTARALEYLHEVCLPPVVHRNLKSSNILLDEEYSPHLSDCGLAALSPNPEREVSTEVVGSFGYSAPEFAMSGTYTVKSDVYSFGVVMLELLTGRKPLDRSRERSEQSLVGWATPQLHDIDALAKMVDPAMDGMYPAKSLSRFADIIALCVQPEPEFRPPMSEVVQQLVRLLQRASMLRRQSAEDLGSSYRAPEREGGGAAWDAF

SEQ ID NO: 10136 - protein, 1231 aa, Secale cereale
MAAAAASVGHSSRGGGGRIHRLEVENFKSYKGTQTIGPFFDFTAIIGPNGAGKSNLMDAISFVLGVRSAHLRGAQLKDLIYALDDRDKEAKGRRASVRLVYNLPGTGGELQFTRTITGAGGSEYRIDGRLVTWDDYNAKLRSLGILVKARNFLVFQGDVESIASKNPKELTALLEQIAGSDELRREYDELEEQKTSAEEKSALVYQEKRTIVMERKQKKAQKEEAEKHLRLQQDLKLLKTEHLLWQLYSIEKDMEKIEAELEDDRRSLQQVHEDNQSSDNGLAAKRKEQSAFLKKITLCEKSMSKKKLDIDKKQPELLRLKEQISRLKSKIKSCNKEIDKKKDDNKKHLEEMKRLQSALADVTSAIEELNEQGQDEGVKLQLADDQVQEYHRIKEDAGMRTAKLRDEKEVLDKELNADIEAKKNLEENMQQLRSRVDEISSQESELQTKLNKILHSIPKHEDELTRLREDHNKIAKERQSSGAKYLTLKQKVDEIDTQLRELKAVKHESERDARFSETVKSLKRLFPGVHGRMTELCRPSQKKYNLAVTVAMGKFMDAVVVEDESTGKECIKYLKEQRLPPQTFIPLQSIRVKPITERLRTLGGSAQLIFDVIQFDRALEKAVLYAVGNTLVCDKLDEAKTLSWSGERYKVVTVDGILLTKSGTMTGGVSGGMEARSNKWDDSRIESLKKKKSKLEAEMSELGSPRELQRKELAVSEKITGLEKKLHYSNVEQNNLKEKLHKLASEKRNIEKEIDHLEPGKEELESRLAKNEREVRKREKKINEIVDRIYKDFSTSVGVKNIREYEEKQLKDAQALQERKLSLSNQLSKLKYQLEYEQKRDMHAPIAKLNNTHETLEKELKGLQERETRAKADAEHISNQMEELKAEAEDWKLKSDECETTIEELKKQNDSVADALAKLDRQVKLKEGQIVQLRSRQRDIHEKCELEQLKLPTVNDPMDTGSSSQELVLDYNQLSEIYLKEVRLSDRDKLEAEFKQKICTLMAEIERTAPNLKALDQYEALQMKEKEVSEKFEAARKEEREVADKYNSVKQRRYELFMEAFDHISKGIDKIYKQLTKSHTHPLGGTAYLNLENEDEPFLHGIKYTAMPPTKRFRDMEQLSGGEKTVAALALLFAIHSFRPSPFFILDEVDAALDNLNVAKVAGFIRSKSCGSAGSAGEEQDGDGGCGFQSIVISLKDSFYDKAEALVGVYRDSERSCSRTLTFDLTKYKEA

SEQ ID NO: 10137 - protein, 1253 aa, Sorghum bicolor
MAAADGSGGDYRARGGGVGGRIDRLVVENFKSYKGEQTIGPFVDFTAIIGPNGAGKSNLMDAISFVLGVRSAHLRGAQLKDLIYALDDRDKEAKGRRASVRLFYRQSNQEELCFTRSITGGGGGSEYRINGSPVTWDQYNAKLRSLGILVKARNFLVFQGDVESIASKNPKELTALLEQISGSDELRREYDELEEQKARAEEKSALVYQEKRTIVMERKQKKAQKEEAEKHLRLQQDLKLLKTEHYLWQLYTIEKDIEKVEAELVEDRESLQQVQEENRSSDYELTTKKKEQSVFLKKMTVCERNIARKKLEFDKKQPELLKLREQISRLKSKIKSCKKEIDKKKDDHKKHLGELRRLQSDLVEVTEAIEELNEQGQDKSGKLLLADDQLQEYHRIKEDAGMKTAKLRDEKEVIDKKLNADVEAKKNLVENLQQLESRKDEISSQERELQTKLNKILHSIPKLENELTHLHEEHDKIAKERQTSGSRYQNLKQRVDEIETKLRELKADKRENERDARLKETVVTLKRLFPGVHGRMLELCRPSQKKYNLAVTVAMGKFMDAVVVEDENTGKECIKYLKEHRDPPQTFIPLQSVRVKPIIEKLRTLGGSAQQSLVDKAPLLYLLKDVNASVSRERFVFPCLETFLEKAVLYAVGNTLVCDKLDEAKALSWSGERYKVVTVDGILLTKSGTMTGGTSGGMEARSNKWDDSAIESLKKNKNKLETEMSELGSPRELQRKELAISEKITGLEKKLHYSNVEQNNLRGKLAKLASERSNIEAEIKRLKPGEEELETRIAEREAEVRKLEKKINDIVDKVYRDFSISVGVKNIREYEERQLKDVQALQERKLSLSNQMSKLKYQLEYEQKRDMQAPIVKLTETHESLEKELKGLQERESGAKAEEKHILTQMEELKTEADDWKAKSDECEKVIDELKEQNGNVASTLAKLDRQVKSKEAQLAQLISRQREVHEKCELEQLKLPTVNDPMDTGTSSQEPILDYSQLSKSHLQDIRPSERDKHEAEFKKRTGVLLADIERTAPNLKALDQYDALQRKEKEVTERFEAARKEEREIADKYNSVKQRRYELFMEAFDHISKGIDKIYKQLTKSHTHPLGGTAYLNLENEDEPFLHGIKYTAMPPTKRFRDMEQLSGGEKTVAALALLFAIHSFRPSPFFILDEVDAALDNLNVAKVAGFIRSKSCDRVADEQGSDGACGFQSIVISLKDSFYDKAEALVGVYRDSERSCSSTLTFDLRKYREA

SEQ ID NO: 10138 - protein, 515 aa, Triticum aestivum
APEVVSGVSGASEENIRVLFKKAYRTAPSIVFIDEIDAIASKRENLQREMERRIVTQLMTCMDEFHQNVGSDGGELDSQSSEKKPGYVIVIGATNRPDAVDQALRRPGRFDREISLGVPDEIGRKQILKMLTQNLTLEKDQFDLFKIARATPGFVGADLKALVDKAGNLAMKRIIVERKKQSGGGDVNNKQDWWRHPWSEGEMDSLCITMDDFEEAATMVQPSLRREGFSSVPDVTWEDVGGLDSLKKEFDRCIVRCIKHPEVYKDFGVNMQAGFLLFGPPGCGKTLIAKAVAHDAGANFIHIKGPELLNKYVGESESEVRKIFTRARINSPCILFFDEIDALTTKRGKEGGWVVERLLNQLLVELDGADQRHGVYVIGATNRIDVIDEAVLRPGRFGKKHFVPLPGADERVAILKAHTEKKTLSVDVDLNAIARREECNNLTGADLASLVNEAAMAALEERCEFLAKGDSSMSTDLTNKIKLRHFEHALSKVKPSVSEQQRKHFDALSKKYSAN

SEQ ID NO: 10139 - protein, 457 aa, Triticum aestivum
MTCMDEFHQNAGSDGGDLDSQSSEKKPGYVIVIGATNRPDAVDQALRRPGRFDREISLGVPDEIGRKQILKMLTQNLTLEKDQFDLFKIARATPGFVGADLKALVDKAGNLAMKRIIVERKKQSGGGDVNNKQDWWRHPWSEGEMDSLCITMDDFEEAATMVQPSLRREGFSSVPDVTWEDVGGLDSLKKEFDRCIVRCIKHPEVYKDFGVNMQAGFLLFGPPGCGKTLIAKAVAHDAGANFIHIKGPELLNKYVGESESEVRKIFTRARINSPCILFFDEIDALTTKRGKEGGWVVERLLNQLLVELDGADQRHGVYVIGATNRIDVIDEAVLRPGRFGKKHFVPLPGADERVAILKAHTEKKSLSEDVDLNAIARREECNNLTGADLASLVNEAAMAALEERCEFLAKGDSSMSTDLTNKIKLRHFEHALSKVKPSVSEQQRKHFDALSKKYSAN

SEQ ID NO: 10140 - protein, 654 aa, Secale cereale
QGHAPHALRLPHAQEGARRSRGCGRQPAARDRARLGEAPRRVTTDGGGAGDPKQEAGASEGGGGGGAKGPRFSDLGGMQSVIDELMMEVVVPLCHPELPLRLGVRPVAGILLHGPPGCGKTTLAHAIANETGVPFYKISAPEVVSGVSGASEENIRVLFKKAYRTAPSIVFIDEIDAIASKRENLQREMERRIVTQLMTCMDEFHQNVGSDGGELDSQSPEKKPGYVIVIGATNRPDAVDQALRRPGRFDREISLGVPDEIGRKQILKMLTQNLTLEKEQFDLFKIARATPGFVGADLKALVDKAGNLAMKRIIVERKKQSGGGDINNKQDWWRHPWSEGEMDSLCITMDDFEEAATMVQPSLRREGFSSVPDVTWEDVGGLDSLKKEFDRCIVRCIKHPEVYKDFGVNMQAGFLLFGPPGCGKTLIAKAVAHDAGANFIHIKGPELLNKYVGESESEVRKIFTRARINSPCILFFDEIDALTTKRGKEGGWVVERLLNQLLVELDGADQRNGVYVIGATNRIDVIDEAVLRPGRFGKKHFVPLPGADERVAILKAHTEKKSLSEDVDLNAIARREECNNLTGADLASLVNEAAMAALEERCEFLAKGDSSMSTDLTNKIKVRHFEHALSKVKPSVSEQQRKHFDALSKKYSAN

SEQ ID NO: 10141 - protein, 248 aa, Panicum virgatum
VFGVNMQAGFLLFGPPGCGKTLIAKAVAHEAGANFIHIKGPELLNKYVGESESEVRKIFTRARTNSPCILFFDEVDALTTKRGKEGGWVVERLLNQLLIELDGADQRQGVYVIGATNRIDVIDDAVLRPGRFGKKHYVPLPGAEERVSILKAHARSKPISFDVDLAALAHREECNNLTGADLASLVNEAAMAALEERLEFLENGTSSMNSSSLIELSHFERALSKVKPSVSEQQIKHYEALSKRYSSN

SEQ ID NO: 10142 - protein, 772 aa, Setaria italica
MRKRPRPGGAGNFEKRIRRRILNGGLAGAGASAEDVASTLRVHYPELRRQKPDPFTALVRRVLSSIPSPSSPSGSDGGDYDDAEDSSASRHRHRHRHRHDAHASTSSSTSVSDEVAHPPPAPAYDVTKSVIRSNYAAQTAKRNPASNQQLEIEETAEKARRLITSDGGAGGDAKPEAMASEGIVRGDKGPRFADLGGMEAVIEELMMEVVVPLCHPELPQRLGVRPVAGLLLHGPPGCGKTTLAHAIANETGVPFYKISAPEVVSGVSGASEENIRGLFQKAYRTAPSIVFIDEIDAIASKRENLQREMERRIVTQLMTCMDQFHQNIGPGGGDLDAESSEKKPGYVIVIGATNRPDAVDQALRRPGRFDREISLGVPDENARKQILKMLIQNLRLEGNFDLFKIARATPGFVGADLKALVDKAGNLAMKRIIDKRRAQYYHEHNGNSKHDWWRQPWDAGEVEGLHITMYDFEEATKMVQPSLRREGFSSVPDVTWDDVGGLNSLRKEFDRCIIRCIKHPEDYEVFGVNMQAGFLLFGPPGCGKTLIAKAVAHEAGANFIHIKGPELLNKYVGESESEVRKIFTRARTNSPCILFFDEVDALTTKRGKEGGWVVERLLNQLLIELDGADQRQGVYVIGATNRIDVIDDAVLRPGRFGKKHYVPLPGADERVSILKAHARSKPISSDVDLEALARREECNNLTGADLASLVNEAAMAALEERLDFVEHGTSSMSSSCLIELSHFERALSKVKPSVSEQLIKYYEALSKRYSSN

SEQ ID NO: 10143 - protein, 775 aa, Sorghum bicolor
MAKRPRHAGNGAGRSQMTSLEWKLHRHILNGGLARRGASAEDVANTLRIHHPDLGRHKQGPFLACVRRALASIPIPSPSSPSSSESSSDDEGSSASRRRRRRHDAHATTSSSTSVSDAAAHSSPPAPTFDLTKSIIRSNYAAQTPKRNQQLEIEVTAEKPRRLITADGGGGGDAKPEAAPAAAEGFGRGDKGPRFADLGGLEAVIEELMMEVVVPLCHPELPHRLGVRPVAGLLLHGPPGCGKTTLAHAIANETGVPFYKISAPEVVSGVSGASEENIRGLFQKAYRTAPSIVFIDEIDAIASKRENLQREMERRIVTQLMTCMDQFHQNIGSGSGNLDAESSEKKPGYVIVIGATNRPDAVDQALRRPGRFDREISLGVPDENARKQILKMLTQHLRLEGEFDLFKIARATPGFVGADLKALVDKAGNLAMKRIIDERRVQYRREHDGNTNHDWWRQPWDESEVEGLHITMDDFEEATKMVQPSLRREGFSSVPDVTWDDVGGLDSLRKEFDRCIIRCIKHPEDYEVFGVNMQAGFLLFGPPGCGKTLIAKAVAHEAGANFIHIKGPELLNKYVGESESEVRKIFTRARTNSPCILFFDEVDALTTKRGKEGGWVVERLLNQLLIELDGADQRQGVYVIGATNRIDVIDDAVLRPGRFGKKHYVPLPGADERVSILKAHARSKPFSADVDLDALARRAECNNLTGADLASLVNEAAMAALEERLEFLENGTSSMSSSCLIEISHFERALSKIKPSVSEQQIKHYEALSKRYSSN

SEQ ID NO: 10144 - protein, 281 aa, Panicum virgatum
PDVTWDDVGGLDSLRKEFDRCIIRRIKHPEDYEVFGVNMQAGFLLFGPPGCGKTLIAKAVAHEAGANFIHIKGPELLNKYVGESESEVRKIFTRARTNSPCILFFDEVDALTTKRGKEGGWVVERLLNQLLIELDGADQRQGVYVIGATNRIDVIDDAVLRPGRFGKKHYVPLPGAEERVSILKAHARSKPISFDVDLAALAHREECNNLTGADLASLVNEAAMAALEERLEFLENGTSSMNSSSLIELSHFERALSKVKPSVSEQQIKHYEALSKRYSSN

SEQ ID NO: 10145 - protein, 511 aa, Pennisetum glaucum
EVVSGVSGASEENIRGLFQKAYRTAPSIVFIDEIDAIASKRENLQREMERRIVTQLMTCMDQFHQNIGPGGGDLDADSSEKKPGYVIVIGATNRPDAVDQALRRPGRFDREISLGVPDENARKQILKMLTQNLRLEGEFDLFKIARATPGFVGADLKALVDKAGNLAMKRIIDKRRAQYYHEHDGNSKHDWWRQPWDDGEVDGLHITMYDFEEATKLVQPSLRREGFSSVPDVTWDDVGGLDSLRKEFDRCIIRCIKHPEDYEVFGVNMQAGFLLFGPPGCGKTLIAKAVAHEAGASFIHIKGPELLNKYVGESESEVRKIFTRARTNSPCILFFDEVDALTTKRGKEGGWVVERLLNQLLIELDGADQRQGVYVIGATNRIDVIDDAVLRPGRFGKKHYVPLPGADERVSILKAHARSKPISSDVDLDALARREECNNLTGADLASLVNEAAMAALEERLDFFEHGTSSMSSSCLIELSHFERALSKVKPSVSEQIIKHYEALSKRYSSN

SEQ ID NO: 10146 - protein, 772 aa, Panicum virgatum
MAKRPRHGGAGRSRLPPLEGKLRRYILNGGLAVPGASAEEVADTLRIHHPEFRRQKLDPFTALVRRVLSSIPSPSSSSSGSDDDDDDGSSASRRRHDAHATTSSSTSVFDEAAHPPPSPAFDVTKSLLRSQYAARAQTPKRNPAANQQQLEIEENAEKARRLITSDGGAGGDAKPDAAASEGIVRGGKGPRFADLGGMEAVIEDLMMEVVVPLCHPELPQRLGVRPVAGLLLHGPPGCGKTTLAHAIANETGLPFYKISAPEVVSGVSGASEENIRGLFQKAYRTAPSIVFIDEIDAIASKRENLQREMERRIVTQLMTCMDQFHQNIGSGSSDLDAESAEKKPGYVIVIGATNRPDAVDQALRRPGRFDREISLGVPDENARKQILKMLTQNLRLEGEFDLFKIARATPGFVGADLKALVDKAGNLAMKRIIDERRAQYCRNHDGNSKHDWWRQPWDASEVEGLHITMDDFEEATKMVQPSLRREGFSSVPDVTWNDVGGLDSLRKEFDRCIIRRIKHPEDYEVFGVNMQAGFLLFGPPGCGKTLIAKAVAHEAGANFIHIKGPELLNKYVGESESEVRKIFSRARTNSPCILFFDEVDALTTKRGKEGGWVVERLLNQLLIELDGADQRQGVYVIGATNRIDVIDDAVLRPGRFGKKHYVPLPGAEERVSILRAHARSKPISSNVDLIALAHRAECNNLTGADLASLVNEAAMAALEERLEFLENGTSSMSSSSLIELSHFERALSKVKPSVSEQQIKHYEALSKRYSSN

SEQ ID NO: 10147 - protein, 331 aa, Zea mays
MAKRPRHAGNGAGRSQLASFERKLHDLILNGGLAGPGASAEDIANTLRIHHPKFRRLKHGPFFASVRRALTSIPIPSSSDDDGSSASRCRHDAHTTSSASVSDAAAHPSPPAPAFDVTKSTLFSHYAAQTRKRNQNQQLEIEVTAEKPRRLITAEGGGGGDAKPEAVPAAEGFCREDKGPRFADLGGMEAVIEELMMEVVVPLCHPKLPHRLGVRPVAGLLLHGPPGCGKTTLAHAIAIETGVLFYKISAPEVVSGVSGASEENIRGLFQKAYRTAPSIVFIDEIDAIASKRENLQREMERRIVTQLMTCMDQYHQNIGSDTGNLDAESSE

SEQ ID NO: 10148 - protein, 295 aa, Zea mays
MVQPSLRREGFSSVPGVTWDDVGGLDSLRKEFDRCIIRCIKHPEDYEVFGVNMQAGFLLFGPPGCGKTLIAKAVAHEAGANFIHIKGPELLNKYVGESESEVRKIFTRARTNSPCILFFDEVDALTTKRGKEGGWVVERLLNQLLIELDGADQRQGVYVIGATNRIDVIDDAVLRPGRFGKKHYVPLPGADERVSILKAHARSKPISTDVDLDALGRRAECNNLTGADLASLVNEAAMAALEERLEFRDKGTSSLSSSSLIEMPHFERALSKIKPSVSEQQIKNYEALSMRYSSN

SEQ ID NO: 10149 - protein, 391 aa, Panicum virgatum
GVPDENARKQILKMLTQSLRIEGEFDLFKIARATPGFVGADLKALVDKAGNLAMKKVTDGRKAQYSKHDWWRQPWDAGEVEGLHITMDDFEEATKMVQPSLRREGFSSVPDVTWDDVGGLDSLRKEFDRCIIRCIKHPEVYEVFGVNMQAGFLLFGPPGCGKTLIAKAVAHEAGANFIHIKGSELLNKYVGESESEVRKIFTRARTNSPCILFFDEVDALTTKRGKEGGWVVERLLNQLLIELDGADQRQGVYVIGATNRIDVIDDAVLRPGRFGKKLYVPLPNAEERVSILKAHARSKPISSDVDLAALAHREECNRLTGADLSSLVNEAAMAALGERLEFLLGNGTSSMSSSSLIELSHFEHALSKVKPSVSEQQIKHYEALSKRYSSN

SEQ ID NO: 10150 - protein, 248 aa, Panicum virgatum
VFGVNMQAGFLLFGPPGCGKTLIAKAVAHEAGANFIHIKGPELLNKYVGESESEVRKIFTRARTNSPCILFFDEVDALTTKRGKEGGWIIERLLNQLLIELDGADQRQGVYVIGATNRIDVIDDAVLRPGGFGKKHYVPLPGAEEWVSILKAHAQSKPISCDVDLAALAHHEECNNLTGADLASLVNEAAMAALEERLEVLENGTSSMSSSSLIELSHFERALSKVKPSVSEQQIKHYEALSKRYSSN

SEQ ID NO: 10151 - protein, 257 aa, Secale cereale
WRARRWPRPRWFSSDTAAVGVDSGNPVRRRVAALWGNGDHGRLGLGALESRWNPTACPFFLARPADPPTSLACGGAHTLFLTEGGRVFATGLNDFGQLGIGSSMPHTLDPVEVSGFHEKVVEISAGNHHSCAVTADGELFVWGKNSSGQLGLGKSAGKVVSTPRKVDYLADVRVKMTALGSEHSIVVTEDGEALSWGAAGAGRLGHGHKSSFLGFAMTSNEYTPRLIKNLDGIKIKRIAAGMLHSACIDEKGTWKIK

SEQ ID NO: 10152 - protein, 258 aa, Triticum aestivum
MWRARRWPRPRWFSSDTAAVGADSGNPARRRVAALWGNGDHGRLGLGALESRWSPTACPFFLTRPADPPTSLACGGAHTLFLTEGGRVFATGLNDFGQLGIGSSMPHTLDPVEVSGFHEKVVQISTGNHHSCAVTADGELFVWGKNSSGQLGLGKSAGKVVSTPRKVDYLADVRVKMTALGSEHSIVVTEDGEALSWGAAGAGRLGHGHKSSFLGFAMTSNEYTPRLIKNLDGIKIKRIAAGMLHSACIDEKGTWKIK

SEQ ID NO: 10153 - protein, 742 aa, Secale cereale
MSEITSGLRCGIYHQGKLRVNRYNPFEAYVGSESIGDEIIIRGSSNMNRSFDGDIVAVELLPQDQWHDSKSFIADDDEDDNEDDVRLVPNSADDAPRNTNSTQSTVGSSAASVPSRPVGRVVGIIKRNWNSYCGSLEPMPMPAGSGGVAHALFVSKDRRIPKIRIQTRQLGNLLNKRIIVAVDSWDVMSRYPSGHYVRTIGDIGDKETETEVVLIENDINTRPFSTQVLACLPPLPWTLSPEDVANPNRQDLRHVRVFSVDPPGCRDIDDALHCTPLPNGNFEVGVHIADVTNFVHPGTPLDEEASQRATSVYLVGQRIDMLPKPLTEDVCSLRANVERLAFSVIWEMTPDADIISSRYTKSVIKSCAAMSYVEAQARMDDSRLADPLTVDLRNLNSLAKIMRNRRCERGALTLASAEVKFEIDSETHDPLDIGIYQIREANQMIEEFMLAANVSVAEKILQHYPLCSLLRRHPSPTKEMLEPLLRTASSVGLNLDVSSSKALAESLDNAKRDDPYFNKLIRILATRCMTQAVYFCSGDLSLSEYYHYGLASALYTHFTSPIRRYADVVVHRLLAAALDIAKLPPVFQDGPQLTGIADNLNYRHRNAQMASRASVELHTLIYFRTRPVDTEARIVKIKANGFIVFVPKFGIEGPIYLTAKGDKGARLGSRRGAPESNQAWNKHKLCCVAECYDPYGSGGASAPPPQAAAHPQMSNNCNCNISAFTCYDIVLGFFNSTNIGDL

SEQ ID NO: 10154 - protein, 333 aa, Panicum virgatum
NSSRPLGRVAGIIKRNWNSYCGSLQPMPMPAGSGGVAHALFVSKDRRIPKIRIQTRQLENLLNKRIVVAVDSWDVLSRYPSGHYVQTIGDIGDKETETEVVLIENDINTRPFSTQVLACLPPLPWTLSPEDLANPNRQDLRHVRVFSVDPPGCRDIDDALHCSLLPNGNFEVGVHIADVTNFVHPGTPLDEEAAQRGTSVYLVGQRIDMLPKPLTEDVCSLRADVERLAFSVIWEMTPDADIISTRYTKSVIKSCAAMSYVEAQARMDDSRLVDPLTVDLRNLNSLAKIMRQRRCERGALTLASAEVKFEIDSETHDPLDIGIYQIRGGKSND

SEQ ID NO: 10155 - protein, 539 aa, Pennisetum glaucum
SEQRIVVAVDSWDVLSRYPSGHYVRTIGDIGDKETETEVVLIENDINTRPFSTQVLACLPPLPWTLSQEDLANPNRQDLRHVRVFSVDPPGCRDIDDALHCTLLPNGNFEVGVHIADVTNFVHPGTPLDEEAAQRGTSVYLVGQRIDMLPKPLTEDVCSLRADVERLAFSVIWEMTPDADIISTRYTKSVIKSCAAMSYVEAQARMDDSRLVDPLTVDLRNLNSLAKIMRQRRCDRGALTLASAEVKFEIDSETHDPLDIGIYQIREANQMIEEFMLAANISVAEKILKHFPLCSLLRRHPSPTKEMLEPLLRTASSIGLNLDVSSSKALAESLDNAKSNDPYFNKLIRILATRCMTQAVYFCSGDLTFSEYYHYGLAASLYTHFTSPIRRYADVVVHRLLAAALEIAKLPPIFQDGPQLTGIADNLNYRHRNAQMASRASVELHTLIYFRTRPTDTEARIVKVKANGFIVFVPKFGIEGPIYLTPKGDKGGDWVVDEVHQRVTKPGTNISYAVLQSVRIHMEVVEPQPHRPKLQLTLV

SEQ ID NO: 10156 - protein, 285 aa, Secale cereale
HDPLDIGIYQIREANQMIEEFMLAANVSVAEKILQHYPLCSLLRRHPSPTKEMLEPLLRTASSVGLNLDVSSSKALAESLDNAKRDDPYFNKLIRILATRCMTQAVYFCSGDLSLSEYYHYGLASALYTHFTSPIRRYADVVVHRLLAAALDIAKLPPVFQDGPQLTGIADNLNYRHRNAQMASRASVELHTLIYFRTRPVDTEARIVKIKANGFIVFVPKFGIEGPIYLTAKGDKGADWVVDEVHQKVTKPGTNISYAVLQSVMIHMEVVEPQPHRPKLQLTLI

SEQ ID NO: 10157 - protein, 343 aa, Panicum virgatum
MSYVEAQARMDDSRLVDPLTVDLRNLNSLAKIMRQRRCERGALTLASAEVKFEIDSETHDPLDIGIYQIREANQMIEEFMLAANISVAEKILKHFPLCSLLRRHPSPTKEMLEPLLRTASSVGLNLDASSSKALAESLDNAKRDDPYFNKLIRILATRCMTQAVYFCSGDLTFSEYYHYGLAASLYTHFTSPIRRYADVVVHRLLAAALEIAKLPPIFQDGPQLTGIADNLNYRHRNAQMASRASVELHTLIYFRTRPTDTEARIVKVKANGFIVFVPKFGIEGPIYLIPKGEKGGDWVVDEVHQRVTKPGTNISYAVLQTVRIRMEVVEPQPHRPKLQLTLI

SEQ ID NO: 10158 - protein, 335 aa, Citrus sinensis
MDDSRLMDPLTTDLRNMNSLAKKMRQRRIERGALTLASAEVKFQIDTETHDPLDIGMYQIREANQMVEEFMLAANVSVAEQILRQFPLCSLLRRHPSPTKEMLEPLLRTAAAVGLNLDVSSSKALADSLDRAVGDDPYFNKLIRILATRCMTQAVYFCSGDLTPPEFHHYGLAAPLYTHFTSPIRRYADVVVHRLLSASLGIYKLPSVFQDRPQLTSIADNLNYRHRNAQMASRGSVELHTLIYFRKRPTDTEARIVKIRSNGFIVFVPKFGIEGPVYLTPRGQKGSGDWYVDEQQQKIVKMDGNLSYSVLQTVNIHMEVVEPQPNRPKLQLTLI

SEQ ID NO: 10159 - protein, 557 aa, Papaver somniferum
DRRFPKIRIQTRQLDNLLHKRIIVAVDSWDCLSRYPSGHYVRTIGDIGDRETESEVVLIENDIDSRPFSAQVLSCLPPIPWSVSSVDLENPNRQDLRHLRVFSVDPPGCRDIDDALHCTPLPNGHFEVGVHIADVTNFVHPGTPLDDEATQRGTSVYLVERRIDMLPKPLTEDICSLRSDVERLAFSVIWEMTPEAEIISTRYTKSVIKSCAALSYIEAQARMDDSRLMDSLTTDLRNMNALAKIMRLRRIEKGALTLASAEVKFQIDTETHDPLDIGMYQIREANQMVEEFMLAANISVAEKILKHFPVFSLLRRHPSPTKEMLEPLLRTTAALGLGLDVSSSKALADSLDQAVADDPYFNKLIRILATRCMTQAVYFCSGDLTPPEFLHYGLAAALYTHFTSPIRRYADVIVHRLLAAALGIYKLPPIFQDRPQLTSIADNLNYRHRNAQMAGRASVELHTLIYFRNRPTDTEARIVKIRSNGFIVFVPKYGIEGPVYLTSKGDKGGGEWFVDEEHQKVKKMDGSISYSVLQAVKIHMEVVEPQPNRPKLQLTLI

SEQ ID NO: 10160 - protein, 759 aa, Papaver somniferum
EAYVRSLNRPDLLDLVVVRQSSEDVNMEDVEDHRPSKRKAIYTEHKPMSEITSGLHRGIFHQGKLRVNRYNPFEAYVGSESIGDEIIIHGRSNMNRAFDGDIVAAELFPKEQWHDGKSSSIAEDEDEEDEDVHLVPNSSDDAPRNTKVVQEAANDMSSDSSRPTGRVVGIIKRNWQSYCGSLEPMDMPAATGGVAHALFVTKDRRFPKIRIQTRQLENLLHKRIIVAVDSWDCLSRYPSGHYVRTIGDIGDRETESEVVLIENDIDSRPFSAQVLSCLPPIPWSVSSVDLENPNRQDLRHLRVFSVDPPGCRDIDDALHCTPLPNGHFEVGVHIADVTNFVHPGTPLDDEATQRGTSVYLVERRIDMLPKPLTEDICSLRFGVERLAFSVIWEMTPEAEIISIRYTKSVIKSCAALSYLEAQARMDDSRLMDSLTTDLRNMNALAKIMRLIRIEKGALTLASAEVKFQIDTETHDPLDIGMYQIREANQMVEEFMLAANISVAEKILKHFPVFSLLRRHPSPTKEMLEPLLRTTAALGLGLDVSSSKALADSLDQAVADDPYFNKLIRILATRCMTQAVYFCSGDLTPPEFLHYGLAAALYTHFTSPIRRYADVIVHRLLAAALGIYKLPPIFQDRPQLTSIADNLNYRHRNAQMAGRASVELHTLIYFRNRPTDTEARIVKIRSNGFIVFVPKYGIEGPVYLTSKGDKGGGEWFVDEEHQKVKKMDGSISYSVLQAVKIHMEVVEPQPNRPKLQLTLI

SEQ ID NO: 10161 - protein, 932 aa, Eucalyptus grandis
MLHNKSFVKKTRAGKITKNVREHYLRDDIYCGVPTCKVCDASAARLSGSASSPILVLDTNVVLNQIDLLENPAIDDVVVLSIVLQEVRNRNLAVYNRIRALCSNLAKKFFVFSNEHHKDTFVQDMAGESKNDRNDRAIRVAAQWYQSHLGGAAQVLLITNDRENKRKATEEGIPAETIEAYVKSLDRKDLLDLLVRPASEDVVMEGVEDLRPSKRKVIYTEHKPLSEITSGLHRGIYHQGKLRVNRYNPFEAYVGSESIGDEIIIYGRGNMNRAFDGDIVAVELLPQDQWQEENSLSLADEEDEEEGVHLVPGSADDAPRTTNLVQGASGPPPSRPSGRVVGIIKRNWHSYCGSLEPMPMPAGDGGVAHALFVSKDRRIPKIRIQTRQLGNLLNKRIVVTVDSWDRLSRYPSGHYVRTIGEIGDRDAESEVVLIENDIDARPFSSQVLACLPPLPWSVSSEDLANPIRQDLRHLRVFSVDPPGCKDIDDALHCTALSNGNFEVGVHIADVTNFLHPSTPLDDEAAQRGTSVYLVERRIDMLPKPLTEDICSLRADVERLAFSVIWEMTPEAEIISTRYTKSIIKSCAALSYIEAQTRMDDSRLADPLTTDLRNMNTLAKIMRHRRIERGALTLASAEVKFQIDTETHDPLDIGMYQIREANQMVEEFMLAANVSVAEKILKHYPLCSLLRRHPIPTKEMLEPLLRTAASVGLELDVSSSKALADSLDRAVGEDPYFNKLIRILATRCMTQAVYFCSGDLTPPEYQHYGLAAPLYTHFTSPIRRYADVIVHRLLAASLGIDKLPAIFQDRPQLTSIADNLNYRHRNAQMAGRASVELHTLIYFRKRPTDTEARIVKIRSNGFIVFVPKFGIEGPVYLTERSEKGGGEWFVDEQQQKIKKMDGSISYGVLQKVNIHMEVVEPQPNRPKLQLALV

SEQ ID NO: 10162 - protein, 558 aa, Citrus clementina
MLKSKSYSRKTKSNKIKKEVREVYLRDDIWCGAASCSTCDSSAARLSASTILVVDTNVVLNQIDLLENPAIDDVVVLSVVLDEVKNKNLSVYNRIRALCSNSLRNFYVFSNTFHKDTHVDKMDKESPNDLNDRAIRVATQWYQKHLGDATKVLLVTNDRENMRKATEQGIFAETIESYVKSLGQPNLLDLLVHPASEDVNMEDVEDLRPSKRKVIYPEHKPMSEITSGLRRGIYHQGKLRVNRYNPFEAYVGSESIGDEIIIYGRTNMNRAFDCDIVAVELLPQEQWHEEKSLFIAAEEDDEDEDDVHLAPSSADDAPRTASVAAAAAGENSAPSRPSGRVVGIIKRNWHSYCGSLEPMPMPAGSGSVAHALFVPKDRRIPKIRIQTRQLGNLLDKRIIVAVDSWDCQSRYPFGHYVQVIGEIGDRDTESEMVLIDNDIDARPFSTQVLACLPPLPWSVSSEDLANPIRLDLRDLRVFSVDPPGCKDIDDALHCTALSSGNFEVGVHIADVTNFVHPGTPLDDEAAKRGTSVYLVERRIDMLPKPLTEGKFIYMFTAG

SEQ ID NO: 10163 - protein, 854 aa, Amsonia hubrichtii
VVLSVVLEEVKNKNIGIYNRLRALCSTSSRKFFVFSNQHHRDTYVKEMAGETPNDRNDRAIRVASQWYQNHLGASVRVILITNDRENQRKALEEGISAETVESYVKSLDKPELLDLIVQPPSEDVTMEDVEDLRPSKRKVVYPEHKPMSEITSGLLRGIYHQGKLRVNRYNPFEAYVGSESIGDEIIIYGRANMNRAFDGDIVAVELLPQEQWHDEKSLLIADEEDEEEDVHLAPSSADDAPRATNLVQESVGGASAVPSRPSGHVVGIIRRNWKSYCGSLEPMPMPAGDGGIAYALFVSKDRRIPKIRIKTRQLGNILDKRIVVAVDSWDCLSRYPSGHYVRTIGEIGDRDTESEVVLIENDIDARPFSSQVLSCLPPLPWSVSSEDLANPIRQDLRHLCVFSVDPPGCKDIDDALHCTALPNGNFEVGVHIADVTNFVLPGTALDNEASQRGTSVYLVERRIDMLPKPLTEDICSLCADVERLAFSVIWEMTPEAEIISTKYTKSVIKSCAALSYVEAQARMDDSRLVDPVTTNLRNMNALAKIMRQRRIDRGALTLASAEVKFQIDTETHDPLDIGMYQIREANQMVEEFMLAANVSVAEKILKHFPLCSLLRRHPSPTKEMLEPLLRTAAAVGLSLDVTSSKALAESLDRAVADDPYFNKLIRILATRCMTQAVYFCSGDLSPPEFNHYGLASPLYTHFTSPIRRYADVIVHRLLAASLGINRLPDVFQDRPQLTSIADNLNYRHRNAQMASRASVELHTLIYFRNRPTDTEARIVKIRSNGFIVFVPKYGIEGPVNLNKKGGEWLADEQQQRVKRSDNSISYGVLQKVQIHMEVVEPQPHRPKLELTLI

SEQ ID NO: 10164 - protein, 932 aa, Solanum phureja
MLKNKAFSRQTRQGRIIKEVREHYLRDDIYCGAPYCKNGCKVSSPCLSDSHFTILVLDTNVVLNQIDLLENQAIDNVVVLSVVLSEVKNKNISVYNRLRALCSSSLRKFFVFSNENHKDTYVKAMAGESPNDRNDRAIRVAAKWYQDHLGSAVSVLLITNDRENKKKAIEEGISAETVECYVKSLGQPELLDLIVQPPSEDVNMADVEDLRPSKRKVIYNEHKPMSEITSGLLRGLLHQGKLRVNRFNPFEAYVGSESIGDEIIIYGRANMNRAFDGDIVAVELLPPEQWHEEKSLALADEDDEEEDVHLAPNTADDAPRVLNQGQTAPEEMKPSRPTGCVVGIIKRNWHSYCGSLEPMPMPAGDGGRAHALFVSKDRRIPKIRIQTRQLGNLLDKRIIVAVDSWDRLSRYPTGHYVRTIGEIGDRDTETEVVLIENDIDARPFSAQVLACLPPLPWSVSSQDLTNPIRQDLRHLRVCSVDPPGCRDIDDALHCMALSNGNFEVGVHIADVTNFVHPGTPLDDEASQRGTSVYLVERRIDMLPKPLTEDICSLRSDVERLAFSVIWEMTPDAEIISARYTKSVIKSCAALSYVEAQARMDDSRLVDPITSDLRNLNGLAKIMRQRRIDRGALTLASAEVKFQIDTETHDPLDIGMYQIREANQMVEEFMLAANVAVAEKILKHFPVCSLLRRHPSPTKEMLEPLLRTAEAVGLSLDLTSSKALADSLDLAKGDDPYFNKLIRILATRCMTQAVYFCSGDLSPPEYLHYGLASPLYTHFTSPIRRYADVIVHRLLAASLGIYQLPGVFQDKPKLTSISDNLNYRHRNAQMASRASVELHTLIFFRKRPTDTEARIVKIRSNGFIVFVPKYGIEGPVYLTSKGDNGGEWVVDEKQQKIRKLDGSVSYGVLGTVRIHMEVVEPQPNRPKLQLTLV

SEQ ID NO: 10165 - protein, 935 aa, Solanum lycopersicum
MLKNKAFSRQTRQGRIIKEVREHYLRDDIYCGAPYCKNGCKVSSPCLSDSHFTILVLDTNVVLNQIDLLENQAIDNVVVLSVVLSEVKNKNIAVYNRLRALCSNSLRKFFVFSNENHKDTYVKTMAGESPNDRNDRAIRVAAKWYQDHLGSAVSVLLITNDRENKKKAIEEGISAETVECYVKSLGQPELLDLIVQPPSEDVKMDDVEDLRPSKRKVIYNEHKPMSEITSGLLRGLLHQGKLRVNRFNPFEAYVGSESIGDEIIIYGRANMNRAFDGDIVAVELLPPEQWHEEKSLALADEDDEEEDVHLAPNTADDAPRALNQGQTAPEEMKPSRPTGCVVGIIKRNWHSYCGSLEPMPMPAGDGGRAHALFVSKDRRIPKIRIQTRQLGNLLDKRIIVAVDSWDRLSRYPTGHYVRTIGEIGDRDTETEVVLIENDIDARPFSAQVLACLPPLPWLVSSQDLTNPIRQDLRHLRVCSVDPPGCRDIDDALHCMPLSNGNFEVGVHIADVTNFVHPGTPLDDEASQRGTSVYLVERRIDMLPKPLTEDICSLRSDVERLAFSVIWEMTPDAEVISTRYTKSVIKSCAALSYVEAQVRMDDSRLVDPITSDLRNLNGLAKIMRQRRIDRGALTLASAEVKFQIDTETHDPLDIGMYQIREANQMVEEFMLAANVAVAEKILKHFPVCSLLRRHPSPTKEMLEPLLRTAEAVGLSLDVTSSKALADSLDLAEGDDPYFNKLIRILATRCMTQAVYFCSGDLSPPEYLHYGLASPLYTHFTSPIRRYADVIVHRLLAASLGIYQLPGVFQDRPKLTSISDNLNYRHRNAQMASRASVELHTLIFFRKRPTDTEARIVKIRSNGFIVFVPKYGIEGPVYLTSKGDNGGEWVVDEKQQKIRKLDGSVSYGVLGTVRIHMEVVEPQPNRPKLQLTLVSDR

SEQ ID NO: 10166 - protein, 687 aa, Beta vulgaris
MLQSKSFVKKTKGGKVVKVVREHYLRDDIYCGASICKICDSSVARLFSDASTLLILDTNVVLNQIDLLENPAIDEVVVLSVVLDEVKNKNLSVYNRLRALCGNSQRKFFVFSNEHHKETYVKGMIGESPNDRNDRAIRVATQWYQKHLGSAVRVLLVTNDRENKRKANEEGILAETVESYVKSLGQPALLDLVAQPASEDMVMDGVEDLRPSKRKVIYSEHKPMSEITAGLHRGIYHQGKLRVNRYNPFEAYVGSESIGDEIVIHGRTNMNRAFDGDIVAVELLPQDQWHGEKSRIADEEDEEDENVRLAPNSADDAPRNTNVQGSSADDTPGRPSGLVVGVIKRNWHSYCGSLEPMSLPAGSGGTVHALFVSKDRRIPKIRIQTRQLGNLLDKRIIVAVDSWDRLSRYPSGHYVQTIGVIGDRETETEVVLIENDINSRPFSSQVLACLPPLPWSVSPEHLSDPNREDLRNLRVFSVDPPGCRDIDDALHCIPLPNGNFAVGVHIADVTNFVHSGTPLDDEASQRGTSVYLVERRIDMLPKPLTEDICSLRSDVERLAFSVIWEMTPQADIISSRFTKSVIKSCAAMSYVEAQARMDDSRLVDPLTTDLRNMNTLAKIMRQRRIERGALTLASAEVKFQIDTETHDPLDIGMYQIREANQMVEEFMLAANVSVAGKILKHFPFVHY

SEQ ID NO: 10167 - protein, 666 aa, Artemisia annua
MNRAFDGDIVAVEVLTQDQWLNEKSLHIADEDDEEDDGVHLAPSSADDAPRIANSAQGSSENANNAPSRRSGRVVGIIKRNWHAYCGSLEPMAMPAGNAGIAHALFVSKDRRFPKIRIQTRQLGNLLDKRIIVAVDTWDCQSRYPSGHYVRTIGDIGDRETETEVVLIENDIDAKPFTSQVLACLPPLPWSVSSEDLSNPIRQDLRHLRIFSVDPPGCKDIDDALHCTSLPNGNFEVGVHIADVTNFVHPGTPLDNEATQRGTSTYLVERRIDMLPKPLTEDICSLRADVERLAFSVIWEMTSDAHVISTRYTKSVIKSCAALSYVEAQARMDDSRLLDPVTTDLRNMNMLAKIMRARRIERGAITLASAEVKFQVDTETHDPLDIGMYQIREANQMVEEFMLAANVSVAEQILKSFPQCSLLRRHPSPTKEMLEPLLRTAASVGLDLDVSSSKALADSLDRAVGEDPYFNKLIRILATRCMTQAVYFCSGELSPPEFHHYGLAAPLYTHFTSPIRRYADVIVHRLLAASLGIYKLPPIFQDRPQLTSIADNLNYRHRNAQMASRASIELHTIIFFRKRPTDTEARIVKIRANGFIVFVPKYGIEGPVYLTMRGEKGGGEWVVDEQQQKIRKIDGSISYGVLQTVQIHMEVVEPQPNRPKLQLTLI

SEQ ID NO: 10168 - protein, 393 aa, Cirsium arvense
MLPKPLTEDICSLRADVERLAFSVIWEMTPDAHVISSRFTKSVIKSCAALSYVEAQARMDDSRLMDPVTTDLRNMNTLAKIMRQRRIERGAITLASAEVKFQVDTETHDPLDIGMYQIREANQMVEEFMLAANVSVAEQILKNFPLCSLLRRHPSPTKEMLEPLLRTAASVGLDLDVSSSKALADSLDHAVAEDPYFNKLIRILATRCMTQAVYFCSGDLSPPEFHHYGLAAPLYTHFTSPIRRYADVIVHRLLAASLGIYKLPTIFQDRPQLTSIADNLNYRHRNAQMASRSSIELHTIIFFRKRPTDTEARVVKIKANGFIVFVPKYGIEGPVYLTMRGEKGGGEWVVDEQQQKIKKIDGSISYGVLQTVNIHMEVVEPQPNRPKLQLTLI

SEQ ID NO: 10169 - protein, 431 aa, Euonymus alatus
EVGVHIADVTNFVHPGTPLADEASQRGTSVYLVERRIDMLPKPLTEDICSLRADVERLAFSVIWEMTPQAEIISTRYTKSVIKSCAALSYVEAQARMDDSRLIDPLTTDLRAMNTLAKIMRQRRVERGALTLASAEVKFQIDTETHDPLDIGMYQIREANQMIEEFMLAANVSVAEKILKHFPLCSLLRRHPTPTKEMLEPLLRTAAAIGLNLDVTSSKALADSLDNAVGDDPYFNKLIRILATRCMTQAVYFCSGDLSPPEFHHYGLASPLYTHFTSPIRRYADVIVHRLLAASLDISKLPQIFQDRTQLTSIAENLNYRHRNAQMASRASVELHTLIYFRKRPTDEEARIVRIRSNGFIVFVPKYGIEGPVYLVPRGEKGDGEWFVDEQQQKVKKMDGSVSYSVLQSVKIHMEVVEPQPNRPKLELSLI

SEQ ID NO: 10170 - protein, 896 aa, Silene vulgaris
KVCDASVSRLSADASTILVLDTNVVLNQIDLLEKTAIDDVVVLSVVLDEVQNKNKSVYKRLRDICSNPSRKYYVFSNEHHKETYVKAMAGESPNDRNDRAIRVAAQWYQKHLNSAVRVLLITNDRENKRKACEEGIAAETVESYVRSLGQPELLDSLRQPSSEDVAMDDVEDLRPSKKQAIYSEHKPMSEITAGLHRGIYHQGKLRVNRYNPFEAYVGSESIGDEIIIHRRANMNRAFDGDIVAVELLAQDQWHGDKSYIADEDEEYEGVGLPPGCADYAPRTTNVQGSNTEALITSDRPCGYVVGIIKRNWHSYCGSLEPMNLPAGSGGVAHPLFVSKDRRIPKIRIQTRQLGNLLDKRIIVTVDSWDRFSRYPSGHYVKTIGEINDRDTETEVVLIENDINSRPFSSQVLACLPPLPWSVAPEHISDPNREDLRSLRVFSVDPPGCRDIDDALHCTPLLNGNFEVGVHIADVTNFVHPGTPLDDEASQRGTSVYLVERRIDMLPKPLTEDICSLRSDVERLSFSVIWEMTPQADIVSSRFTKGIIKSCAALSYVEAQARMDDSRLMDPVTTDLRNMNQLAKIMRQRRIDRGALTLASAEVKFQIDTETHDPLDIGMYQIREANQMVEEFMLAANIAVAEKILKHYPFCSLLRRHPSPTREMLEPLLRTAAAIGLDLDVTSSKALADSLDRAVGNDPYFNKLIRILATRCMTQAVYFCSGDVSPPEYLHYGLAAPLYTHFTSPIRRYADVIVHRLLAASIGISKLPVIFQDRPQLTSIADNLNYRHRNAQMAGRASVELHTLIYFRKRPTDTEARIVKIRSNGFIVFVPKFGIEGPVYLTAKGDKESGEWVVDEQHQQVKKVDGSITYNVLQMVQIHMEVVEPQPNRPKLQLNLI

SEQ ID NO: 10171 - protein, 711 aa, Valeriana officinalis
MLQSKSFVRKTKQGKVVKVVREHYLRDDIYCGASFCKVCDTSTARLSSSASTILVIDTNVVLNQIDLLENPAIDEVVVLSVVLEEVKHKNVAVYNRLRALCSSSSRKFFVFSNEYHKDTYVKAMAGETPNDRNDRAIRVAAQWYQNHLGNAFRVLLITNDRENKRKASEEGISAETVESYVRSLGQPALLDLLVQPPSEDTRMEDADDSRPSKRKVIYNEHKPMSEITSGLLRGIFHQGKLRVNRYNPFEAYVGSESIGDEIIIYGRGNMNRAFDGDVVAVELLPQDQWHDEKSLSIAEQEDEEDDDVHLAPSSADDAPVKGSNGDMSNVPPRPSGRIVGIIKRNWKSYCGSLDPMPMPAGNGGVAHALFVSKDRRIPKIRIQTRQLGNLLDKRIIVSVDSWDCASRYPSGHYVRTIGDIGDRDTESEVVLIENDIDARPFTSQVLACLPPLPWNVSAEDLANPIRQDLRHLRVFSVDPPGCKDIDDALHCTLSPNGNFEVGVHIADVTNFVHPGTPLDDEATQRGTSVYLVERRIDMLPKPLTEDICSLRADVERLAFSVIWEMTPEAEIISTRYTKSVIKSCAALSYVEAQARMDDSRLMDPVTTDLRNMNALAKKMRQRRIDRGALTLASAEVKFQIDTETHDPLDIGMYQIREANQMVEEFMLAANISVAEKILQTFSTMLFVKAASKSNKKCLTFTSYSSRCWRQS

SEQ ID NO: 10172 - protein, 325 aa, Aristolochia fimbriata
PLTTDLRNLNSLAKIMRQRRIDRGALTLASAEVKFQIDTETHDPLDIGMYQIREANQMIEEFMLAANVSVAEKNLKHFPLCSLLRRHPSPTKEMLEPLLRTAAAIGLSLDASSSKALADSLDRAVGDDPYFNKLIRIMATRCMTQAVYFCSGDLTPPEFHHYGLASPLYTHFTSPIRRYADVIVHRLLAAALAIEKLPPIFEDRPQLTNVADNLNNRHRNAQMASRASVELHTLIYFRNRPTDTEARIVKIRSNGFIVFVPKYGIEGPVYLIRKGEKGEWLVDEKHQRVTKADASVSYSVLQPVRIHLEVVEPQPHRPKLELSLI

SEQ ID NO: 10173 - protein, 936 aa, Euonymus alatus
MLQSKVFSKRTRGGKVQKTVREVYLRDDLACGAPFCKVCDTSKARLTASGSSPILIVDTNVVLSQIDLLENPAINNVVVLSVVRDEVKKRNMAVFKRIETLCYNSTRNFFVFYNTLHKDTFVHDVSGESPNDRNDRAIRVATQWYQNHLGGETRVLLITNDRENKRKATEEGISTETIESYVKSLGQPNLLDLLVKPVSEDVEMENPDALIPSKRRVLYAEHKPMSEITSGLRCKIYHQGKLRVNRYNPFEAYVGSESIGDEIIIYGHANMNRAFDGDIVAVELLPQDQWLEEKFLSIAEEGEEEEEEDVHLAPNTADDAPRNTNLPNSADDKKSVPCRPAGHVVGIIKRNWHSYSGSLEPLPMPAASGSIAHALFVPKDRRISKIRIQTRQLENLLDQIIVVAVDSWDRKFRYPSGHYVRKIGEIGDRNVESQAVLMESDICDEPFSRQILNCLPPLPWSVSAEDLADPIRMDLRHLRVFSVDPPGCKDIDDALHCTALPNGNFEVGVHIADVTNFVHPGTPLDDEASQRGTSVYLVERRIDMLPKPLTEDICSLRADVERLAFSVIWEMTPQAEIISTRYTKSIIKSCAALSYVEAQARMDDSRLIDPLTTDLRAMNTLAKIMRQRRVERGALTLASAEVKFQIDTETHDPLDIGMYQIREANQMIEEFMLAANVSVAEKILKHFPLCSLLRRHPTPTKEMLEPLLRTAAAVGLNLDVTSSKALADSLDHAVGDDPYFNKLIRILATRCMTQAVYFCSGDLSPPEFHHYGLASPLYTHFTSPIRRYADVIVHRLLAASLEISKLPQIFHDRTQLTSIAENLNYRHRNAQMASRASVELHTLIYFRKRPTDEEARIVRIRSNGFIVFVPKYGIEGPVYLVPRGEKGDGEWFVDEQQQKVKKMDGSVSYSVLQSVKIHMEVVEPQPNRPKLQLSLI

SEQ ID NO: 10174 - protein, 932 aa, Helianthus annuus
MLQSKSFVRKTKQGKVVKVVREHYLRDDIYCGASFCKVCDTKGARFTSPECTILVLDTNVVLNQIDLLENSAIDDVVVLSVVLDEVKNKNLAVYNRLRALCSNTLRRFFVFSNEHHKDTYVKAMAGESPNDRNDRAIRVAAQWYQNHLGGPTRILMVTNDRENKRKATEEGISADTVESYVKSLGQPALLDLLVQPNSSEDMEIEDLRPSKKKAIYTEHKPMSEITSGIRCGIYHQGKLRVNRYNPFEAYVGSESIGDEIIISGRGNMNRAFDGDVVAVELLPQDQWQNEASLHIAEEDDEDDGVHLAPSSADVAPRITNPAQGSSENANNPPSRPSGRVVGIIKRNWHAYCGSLEPMPMPAGNAGIAHALFVSKDRRFPKIRIQTRQLGNLLDKRIIVAVDTWDCQSRYPSGHYVRTIGDIGDRETETEVVLIENDIDARPFSSQVLACLPPLPWSVSSEDLSNPIRQDLRHLRIFSVDPPGCKDIDDALHCTPLPNGNFEVGVHIADVTNFVHPGTPLDSEATQRGTSTYLVERRIDMLPKPLTEDICSLRADVERLAFSVIWEMTPEAHVISTRYTKSVIKSCAALSYVEAQARMDDSRLMDPVTADLRNMNALAKIMRQRRIERGAITLASAEVKFQVDTETHDPLDIGMYQIREANQMVEEFMLAANVSVAEQILKKFPQCSLLRRHPSPTKEMLEPLLRTAAAVGLDLDVSSSKALADSLDRAVGDDPYFNKLIRILATRCMTQAVYFCSGDLSPPEFHHYGLAAPLYTHFTSPIRRYADVIVHRLLAASLDIYKLPPIFQDRPQLTSIADNLNYRHRNAQMASRSSIELHTIIFFRKRPTDTEARIVKIRANGFIVFVPKYGIEGPVHLTMRGAKGGGEWVVDEQQQMIKKVDGSISYGVLQPVKIHMEVVEPQPNRPKLQLTLI

SEQ ID NO: 10175 - protein, 922 aa, Eutrema parvulum
LVILSRQQVREVYLRDDIYCGAFSCNSCDTSAARLSSPKIIVVDTNVVLHQIDLLENQAIDNVVVLSVVLDEVKNRNRSVYNRIRALCSNPARQFYVFSNHVHKDTYVQAMERESANDHNDRAIRVATLWYQKHLGATSQVLLVTNDRENKRKATEEGISAETIEAYVKSIGQPELLDLLAQPTTEDVTMEDADDSRPSKRKLVYLEHKPMSEITAGLHRGIYHQGKLRVNRFNPFEAYVGSESIGEEIIIYGRSNMNRAFDGDIVAVELLPRDQWQEEKALSIAEEDEEEDDTVHLAPNSADDAPRTSNLAQETSGDKNANPARPSGRVVGVIRRNWHSYCGSLEPMSLPAGSGGTAHALFVSKDRRIPKIRINTRQLQNLLDMRIVVAVDSWDGQSRYPSGHYVRPIGKIGDRETETEVVLIENDVDYSPFSSQVLSCLPPLPWSVSSEDVSNPVRQDLRHLLVFSVDPPGCKDIDDALHCTSLPNGNFELGVHIADVTNFVHPGTPLDDEASKRGTSVYLVERRIDMLPKPLTEDICSLRADVERLAFSVIWEMNPEAEIISTRFTKSIIKSSAALSYVEAQARMDDSRLTDPVTTDLRNMNALAKIMRQRRIDRGALTLASAEVKFQIDTETHDPLDIGMYQIREANQMVEEFMLAANVSVAEQILKQFPSCSLLRRHPTPTREMLEPLLRTAAAIGLSLDVSSSKALADSLDRAVGEDPYFNKLIRILATRCMTQAVYFCSGDLSPPEYLHYGLAAPLYTHFTSPIRRYADVFVHRLLAASLGIYKLPMVFQDRPQLTSVADNLNYRHRNAQMASRASVELHTLIYFRNRPTDAEARVVKIRSNGFIVFVPKYGIEGPVYLTAKGEKGAGDWYVDEEKQKIVKMDGSLSYSVLQTVKIHMEVVEPQPNRPKLELTLL

SEQ ID NO: 10176 - protein, 933 aa, Eutrema halophilum
MLQSKVFNKKTRGGRIQKQVREVYLRDDIYCGAFSCKSCDTSAARLSSPKIIVVDTNVVLHQIDLLENQAIDSVVVLSVVLDEVKNRNRSVYNRIRALCSNPARQFYVFSNHVHKDTYVQAMERETANDHNDRAIRVATLWYQKHLGDSSQVLLVTNDRENKRKATEEGISAETIEAYVKSIGQPELLDLLAQPTTEDVTMEDADDSRPSKRKLVYLEHKPMSEITAGLHRGIYHQGKLRVNRFNPFEAYVGSESIGEEIIIYGRSNMNRAFDGDIVAVELLPRDQWQEEKALSIAEEDEEEDDTVHLAPNTADDAPRTSNLPQETSGDKNAIPARPSGRVVGIIRRNWHSYCGSLEPMSLPAGSGGTAHALFVSKDRRIPKIRINTRQLQNLLDMRIVVAVDSWDRQSRYPSGHYVRPIGKIGDRETETEVVLIENDVDYSPFTSQVLACLPPLPWSVSPEDVSNPVRQDLRHLLVFSVDPPGCKDIDDALHCTSLPNGNFELGVHIADVTNFVHPGTPLDDEASKRGTSVYLVERRIDMLPKPLTEDICSLRADVERLAFSVIWEMNPEAEIISTRFTKSIIKSSAALSYVEAQARMDDSRLTDSVTTDLRNMNTLAKIMRQRRIDRGALTLASAEVKFQIDTETHDPLDIGMYQIREANQMVEEFMLAANVSVAEQILKHFPSCSLLRRHPTPTREMLEPLLRTAAAIGLNLDVSSSKALADSLDRAVGEDPYFNKLIRILATRCMTQAVYFCSGDLTPPEYLHYGLAAPLYTHFTSPIRRYADVFVHRLLAASLGIYKLPTVFQDRPQLTSVADNLNYRHRNAQMASRASVELHTLIYFRNRPTDAEARVVKIRSNGFIVFVPKYGIEGPVYLTAKGEKGAGDWYVDEEKQKIVKMDGSLSYSVLQTVKIHMEVVEPQPNRPKLQLTLL

SEQ ID NO: 10177 - protein, 157 aa, Ambrosia trifida
YAYLVSNPPGCKDIDGALHCTSLPNGNFEVGVHIADVTNFVHPGTPLDSEATQRGTSTYLVERRIDMLPKPLTEDICSLRADVERLAFSVIWEMTPEAHVISTRYTKSVIKSCAALSYVEAQARMDDSRLMDPVTADLRNMNALAKIMRQRRIERGP

SEQ ID NO: 10178 - protein, 338 aa, Fagopyrum esculentum
QARMGDSRLMDSLTTDLRNMNNLAKIMRQRRIDGGALTLASAEVKFQIDTETLDPLDIGMYQIREANQMVEEFMLAANVSVAEKILKHFPICSLLRRHPTPTREMLEPLLRTAAAVGLDLDVSSSKALADSLDRAVGDDPYFNKLIRILATKCMTQAVYFCSGDLSPPEYLHYGLAAPLYTHFTSPIRRYADVVVHRLLAASLGISKLPAIFQDKPQLTSIADNLNYRHRNAQMAGRASVELHTLIYFKNRPVETEARIVKIRSNGFIVFVPKFGIEGPVYLTPSGQKSGGEWVVDEQSQKIRKINGNVCYSILQTVRIRLEVVEPQPHRPKLQLTLI

SEQ ID NO: 10179 - protein, 406 aa, Tripterygium wilfordii
RGTSVYLVERRIDMLPKPLTEDICSLRADVERLAFSVIWEMTPQAEIISTRYTKSIIKSCAALSYVEAQARMDDSRLVDPLTTDLRDMNTLAKIMRQRRIERGALTLASAEVKFQIDTETHDPLDIGMYQIREANQMVEEFMLAANVSVAEKILKHFPLCSLLRRHPTPTKEMLEPLLRTAAAIGLNLDVTSSKALADSLDRAVGDDPYFNKLIRILATRCMTQAVYFCSGDLSPPEFHHYGLASPLYTHFTSPIRRYADVIVHRLLAASLEINKLPQIFQDRTQLTSIAENLNYRHRNAQMASRASVELHTLIYFRKRPTDEEARIVKIRSNGFIVFVPKYGIEGPVYLTPRGEKGDGEWFVDEQQQQVKKMDGSVSYSVLQSVKIHMEVVEPQPNRPKLELSLI

SEQ ID NO: 10180 - protein, 934 aa, Glycine max
MLHNKSFVKKTKGGKVIKQVREHYLRDDIYCGAPFCTVCDSSSARLSASPSIILVVDTNVVLNQIDLLENPAIDDVVVLSIVLEEVKNKNMSVYNRIRAICSNSMRKFFVFSNEYHRDTYIKEMSGETKNDRNDRAIRVATQWYQNHLGGAVKVLLLTNDKENKRKASEEGILAETVESYVKSLDQPDLLDLLVRPASEDVDMEEVEDLRPSKRKVIYSEHKPMSEITSGLHRGIYHQGKLRVNRYNPFEAYVGSESIGDEIIIYGRSNMNRAFDGDIVAAELLPQDQWQGVSSLSIAHEEDEDEDEDVHLAPNSADDAPRTISQQGSSEQVNAVPSRPSGRIVGIIKRNWHSYCGSLEPMPMPAGSGGIAHALFVSKDRRIPKIRIQTRQLENLLDKRIIVAVDSWDRQSRYPSGHYVRTIGEIGDRDTESEVVLIENDINTRPFSSQVLACLPPLPWVVSSEDLSNPIRKDLRHLRVFSVDPPGCKDIDDALHCHVLPNGNFEVGVHIADVTNFVYPGTPLDDEAAQRGTSVYLVERRIDMLPKPLTEDICSLRSDVERLAFSVIWEMTPEADIIATSYTKSVIKSSAALSYVEAQARMDDSRLMDPITADLRNMNSLAKKMRLRRIERGALTLASAEVKFQIDTETHDPLDIGMYQIREANQMVEEFMLAANVSVAQQILKSFPLCSLLRRHPTPTREMLEPLLRTAAAVGLHLDVSSSKALADSLDHAVGDDPYFNKLIRILATRCMTQAVYFCSGDLSPPEYHHYGLAAPLYTHFTSPIRRYADVIVHRLLAASLGISKLPPVFQDSLQLTSIADNLNYRHRNAQYAGRASVELHTLIYFRKRPTDTEGRIVKIRSNGFFVFVPKYGIEGPVYLTKAEKGSGEWYVDEQQQKIKKMDGSLSYNVLQTVQIHMEVVEPQPNRPKLQLTLI

SEQ ID NO: 10181 - protein, 934 aa, Glycine max
MLHNKSFVKKTKGGKVIKQVREHYLRDDIYCGAPFCTVCDSSSARLSASPSIILVVDTNVVLNQIDLLENPAIDDVVVLSIVLEEVKNKNMSVYNRIRAICSNSMRKFFVFSNEYHRDTYIKEMSGETKNDRNDRAIRVATQWYQNHLGGAVKVLLLTNDKENKRKASEEGILAETVESYVKSLDQPDLLDLLVRPASEDVDMEEVEDLRPSKRKVIYSEHKPMSEITSGLHRGIYHQGKLRVNRYNPFEAYVGSESIGDEIIIYGRSNMNRAFDGDIVAAELLPQDQWQGVSSLSIAHEEDEDEDEDVHLAPNSADDAPRTISQQGSSEQVNAVPSRPSGRIVGIIKRNWHSYCGSLEPMPMPAGSGGIAHALFVSKDRRIPKIRIQTRQLENLLDKRIIVAVDSWDRQSRYPSGHYVRTIGEIGDRDTESEVVLIENDINTRPFSSQVLACLPPLPWVVSSEDLSNPIRKDLRHLRVFSVDPPGCKDIDDALHCHVLPNGNFEVGVHIADVTNFVYPGTPLDDEAAQRGTSVYLVERRIDMLPKPLTEDICSLRSDVERLAFSVIWEMTPEADIIATSYTKSVIKSSAALSYVEAQARMDDSRLMDPITADLRNMNSLAKKMRLRRIERGALTLASAEVKFQIDTETHDPLDIGMYQIREANQMVEEFMLAANVSVAQQILKSFPLCSLLRRHPTPTREMLEPLLRTAAAVGLHLDVSSSKALADSLDHAVGDDPYFNKLIRILATRCMTQAVYFCSGDLSPPEYHHYGLAALLYTHFTSPIRRYADVIVHRLLAASLGISKLPPVFQDSLQLTSIADNLNYRHRNAQYAGRASVELHTLIYFRKRPTDTEGRIVKIRSNGFFVFVPKYGIEGPVYLTKAEKGSGEWYVDEQQQKIKKMDGSLSYNVLQTVQIHMEVVEPQPNRPKLQLTLI

SEQ ID NO: 10182 - protein, 933 aa, Malus domestica
MLQNKSFVKRTRGGKITKVVREHYLRHDIYCGAPVCKVCDTSGARLSPTASTILIFDTNVVLHQIDLIENPAIDDVVVLSIVLEEVKNRNLSVYNRVRALCSNSLRKFFVFSNEHHKDTYVTDMSGESKNDRNDRAIRVAAQWYQTHLAGSAKVLLITNDKENKRKAIEEGISAETVESYVRSLSRPELLDLLVQPASEDVKMEDTEDLRPSKRKVIYSEHKPMSEITSGLHRGIYHQGKLRVNRYNPFEAYVGSESIGDEIIIYGRTNMNRAFDGDIVAVELLPQDQWHEEKSLALADEEDEEEDVHLVPGSADDAPRTIAAQGSAGVTEPVQNRPSGRVVGIIKRNWHSYCGSLEPMAKPAGGGGIAHALFVSKDRRIPKIRIQTRQLENLMDKRIIVAVDSWDPLSRYPSGHYVRTIGVIGDKDTETEVVLIENDINTRPFSSQVLACLPPLPWFVSSEDLANPIRQDLRQLRVFSVDPPGCKDIDDALHCTALPNGNYEVGVHIADVTNFVHSGTPLDDEASQRGTSVYLVERRIDMLPKPLTEDICSLRADVERLAFSVIWEMTAEAEIISTRYTKSVIKSCAALSYIEAQARMDDSRLMDPLTTDLRNMNSLAKIMRARRIERGALTLASAEVKFEIDTETHDPLDIGMYQIREANQMVEEFMLAANVSVAEKILKHFPLCSLLRRHPSPTREMLEPLLRTAAAIGLNLDVSSSKALADSLDSAVGDDPYFNKLIRILATRCMTQAVYFCSGDLSPPEYLHYGLAASLYTHFTSPIRRYADVITHRLLAASLGIYKLPTIFQDGPRLTSIADNLNYRHRNAQMASRASVELHTVIFFKKRPTDTEARIVRIRSNGFFVFVPKYGIEGPVYLTPRGEKGGGEWYVDEQQQKIRKMDGSISYSVLQTVFIHMEIVEPQPNRPKLQLSLV

SEQ ID NO: 10183 - protein, 331 aa, Nicotiana benthamiana
SRLVDPITSDLRNLNGLAKIMRQRRIDRGALTLASAEVKFQIDTETHDPLDIGMYQIREANQMVEEFMLAANVAVAEKILKHFPLCSLLRRHPSPTKEMLEPLLRTAEAVGLSLDVTSSKAMADSLDRAVGDDPYFNKLIRILATRCMTQAVYFCSGDLSPPEYLHYGLASPLYTHFTSPIRRYADVIVHRLLAASLGIYKLPGVFQDRPKLTSISDNLNYRHRNAQMASRASVELHTLIFFRKRPTDTDARIVKIRSNGFIVFVPKYGIEGPVYLTSKGENAGEWLADEKQQRIRKVDGSVSYGVLGTVRIHMEVVEPQPNRPKLQLTLV

SEQ ID NO: 10184 - protein, 738 aa, Vinca minor
LAPSEDVSMQDVEDIRPSKRKVVYPEHKPMSEITSGLHCRIYHQGKLRVNRYNPFEAYVGSESIGDEIIIYGRANMNRAFDGDIVAVELLPQEQWHEEKSLVIADEEDEEEDVHLAPSSADDAPRVMNLVQGSAGGASDVPSRPSGRVVGIIKRNWKSYCGSLEPMPMPAASGGTVNALFVSKDRRIPKIRIRTRQLENLLDKRIVVSVDSWDCLSRYPSGHYVRTIGEIGDRDTESEVVLIENDIDARPFSSQVLSCLPPLPWSVSSEDLTSPIRQDLRHLCVFSVDPPGCRDIDDALHCMALPNGNFEVGVHIADVTNFVHPGTALDNEAAQRGTSVYLVERRIDMLPKPLTEDICSLRADVERLAFSVIWEMTPEADIISTKYTKSVIKSCAALSYVEAQARMDDSRLADPVTRDLRNMNALAKIMRQRRIDRGALTLASAEVKFQIDTETHDPLDIGMYQIREANQMVEEFMLAANVSVAEKILKHFPLCSLLRRHPTPTKEMLEPLLRTAAAIGLSLDVTSSKALAESLDRAVGNDPYFNKLIRILATRCMTQAVYFCSGDLSPPEFSHYGLAAALYTHFTSPIRRFADVIVHRLLAASLEINKLPAVFQDRPQLTSIADNLNYRHRNAQMASRGSVELHTLIYFKNRPTDTEARIVKLRSNGFIVFVPKYGIEGPVNLNKKGGEWLVDEQQQRVKKSDNSISYGVLETVHIHMEVVEPQPHRPKLELTLIQK

SEQ ID NO: 10185 - protein, 510 aa, Pennisetum glaucum
SDPLTVDGAGGGGRGGASRFPVDQEVNSRIYLWRGHPWNLEVDAVVNSTNESLDEAHSSPGLHAAAGSGLAEECATLGGCRTGMAKMTNAYDLPARKVIHTVGPKYAVKYHTAAENALSHCYRSCLELLIENGLESIAMGCIYTEAKNYPREPAAHVAIRTVRRFLEKQKGNIAGVVFCTTSSSDTEIYKRLLPLYFPRDKQEEEIAISKLPADVGDENGETVIDERKIRIRPLPAGVVDRTVTATPIDPPLSESGSALKRASFKLDSYLDPSFMSIIKDPDLRRREQWEKSAQAQKGFNYARLLGYGDLGCPSLSAAEEYSLHSRYLAKANSLNLSEIAEMKIIYRGGVDIEGRPVMVVVGAHFLLRCLDLERFVLHVVKEFEPLIQKPYTIVYLHSAASLQPQPDLGFMKRLQQILGRKHQRNLHAIYVLHPTLGLRTAVLAMQMFVDGEVWKKVVYVDRLMQLFRYVPREQLTIPDFVFQHDLEVNGGKGLIVDPRTKHIYQRASSS

SEQ ID NO: 10186 - protein, 441 aa, Triticum aestivum
GLAEECATLGGCRTGMAKMTNAYDLPARKVIHTVGPKYAVKYHTAAENALSHCYRSCLELLIENGLESIAMGCIYTEAKNYPREPAAHVAIRTVRCFLEKQKGKIAGVIFCITSSSDTEIYKRLLPLYFPRDKQEEETAVSKLPADVGDENGETVIDERKIRIRPLPAGAADRTVATAAALDLPLESGLASSRSTFKLDSYLDPSFMSLIKDPDLRRKEQWEKSSQAQKGFNYARLLGYGDIGFPPLSAAEEYSLHSRYLAKANSLNLSEVAEMKIIYRGGVDSEGRPVMVVVGAHFLLRCLDLERFVLHVVKEFEPLIQKPYTIVYLHSAASLQPQPDLGFMKRIQQILGRKHQRNLHGIYILHPTLGLRTAILGMQLLIDGEVWKKVVYVDRLVQLFRYVPREQLTIPDFVFQHDLEVNGGRGMIVDPRTKHIYQRPSG

SEQ ID NO: 10187 - protein, 416 aa, Saccharum officinarum
PARKVIHTVGPKYAVKYHTAAENALSHCYRSCLELLIENGLESIAMGCIYTEAKNYPREPAAHVAIRTVRRFLEKQKGKIAGVVFCTTSSSDTEIYKRLLPLYFPRDKQEEEIAILKLPADVGDENGETVIDERKIRIRPLPAGVVDRTVSATLVDLPLSDSGSALKKGSFKVDSYLDPSFMSIIKDPDLRRKEQWEKSAQAQKGFNYARLLGYGDLACPSLSAAEEYSLHSRYVAKANSVNLSEIAEMKIIYRGGVDIEGRPVMVVVGAHFLLRCLDLERFVLHVVKEFEPLIQKPYTIVYFHSAASLQPQPDLGFMKRLQQILGRKHQRNLHAIYVLHPTLGLRTAVLAMQMFVDGEVWKKVVYVDRLVQLFRYVPREQLTIPDFVFQHDLEVNGGRGLIVDPRTKHIYQRTSS

SEQ ID NO: 10188 - protein, 423 aa, Panicum virgatum
SKFIIWLCRKVIHTVGPKYAVKYHTAAENALSHCYRSCLELLIENGLESIATGCIYTEAKNYPREPAAHVAIRTVRRFLEKQKDKITAIVFCTTSSPDTEIYKRLLPLYFPRDKPEEEIAALKLPADVGDENGETVIDERKIRIKPLPAGAANSKTPIPALADIPLPDSGLTRRRNSFKLDSYLDPAFMSIIKDPDLRRKEQWEKSAQAHKGLNLANLLGFGDLGSPPLSAAEEYSLHSRYLAKANSMNLSDIAEMKIIYRGGVDSEGRAVMVVVGAHFLLRCLDLERFVLYVAKEFEPLIQKPYSIVYFHSAASLQPQPDLGFMKRLQQILGRKHQKNLHAIYVLHPTLGLRTAILAMQLFVDGEVWKKVVYVDRLVQLFRYVPREQLTIPDFVFQHDLEVNGGKGIIVDPRTKHVYQRPSG

SEQ ID NO: 10189 - protein, 513 aa, Pennisetum glaucum
SSSDRLTGDDAAAGPGGRAASRFPVDHEINSKIYLWRGHPWNLEVDAVVNSTNENLDEAHSSPGLHAASGPGLAEECATLGGCRTGMAKMTNAYDLPARKVIHTVGPKYAVKYHTAAENALSHCYRSCLELLIENGLDSIATGCIYTEAKNYPREPAAHVAIRTVRRFLEKQKDKIRAIVFCTTSSSDTEIYKRLLPLYFPRDKQEEEIAALKLPADVGDENGETIIDERKIRIKPLPAGAANSKTPIPTLADIPLPDSGLTRRRNSFKLDSYLDPAFMSIIKDPDLRRKEQWEKSAQANKGINFANLLGFGDLGSPPLSAAEEYSLHSRYLAKANSMNLSDIAEMKIIYRGGVDSEGRPVMVVVGAHFLLRCLELERFVLYVVKEFEPLIQKPYSIVYLHSAASLQPQPDLGFMKRLQQILGRKHQRNLHAIYVLHPTLGLRTAILAMQLLVDGEVWKKTVYIDRLVQLFKYVPREQLTIPDFVFQHDLEVNGGKGIIVDPRIKHVYQRPSG

SEQ ID NO: 10190 - protein, 423 aa, Panicum virgatum
QKFIIWLCRKVIHTVGPKYAVKYHTAAENALSHCYRSCLELLIENGLESIATGCIYTEAKNYPREPAAHVAIRTVRRFLEKQKDKITAIVFCTTSSSDTEIYKRLLPLYFPRDKPEEEIAALKLPADVGDENGETVIDERKIRIKPLPAGAANSKTPIPALADIPLPDSGLTRRRNSFKLDSYLDPAFMSIIKDPDLRRKEQWEKSAQAHKGLNLANLLGFGDLGSPPLSAAEEYSLHSRYLAKANSINLSDIAEMKIIYRGGVDSEGRAVMVVVGAHFLLRCLDLERFVLYVVKEFEPLIQKPYSIVYFHSAGSLQPQPDLGFMKRLQQILGRKHKKNLHAIYVLHPTLGLRTAILAMQLFVDGEVWKKVVYVDRLVQLFRYVPREQLTIPDFVFQHDLEVNGGKGIIIDPRTKHVYQRPSG

SEQ ID NO: 10191 - protein, 212 aa, Saccharum officinarum
GAGGRGASRFPVDHEINSKIYLWRGHPWSLEVDAVVNSTNENLDEAHSSPGLHAAAGTGLAEECATLGGCRTGMAKMTNAYDLPARKVIHTVGPKYAVKYHTAAENALSHCYRSCLELLIENGLESIATGCIYTEAKNYPREPAAHVAIRTVRRFLEKQKDKITAIVFCTISSSDTEIYKRLLPLYFPRDKQEEEIAALKLPADVGMRMVRQ

SEQ ID NO: 10192 - protein, 500 aa, Panicum virgatum
GPGGRGASRFPVDHEINSKIYLWRGHPWNLEVDAVVNSTNENLDEAHSSPGLHAAAGPGLAEECTTLGGCRTGMAKMTNAYDLPARKVIHTVGPKYAVKYHTAAENALSHCYRSCLELLIENGLESIATGCIYTEAKNYPREPAAHVAIRTVRRFLEKQKDKITAIVFCTTSSSDTEIYKRLLPLYFPRDKPEEEIAALKLPADVGDENGETVIDERKIRIKPLPAGAANSKTPIPALADIPLPDSGLTRRRNSFKLDSYLDPAFMSIIKDPDLRRKEQWEKSAQAHKGLNLANLLGFGDLGSPPLSAAEEYSLHSRYLAKANSINLSDIAEMKIIYRGGVDSEGRAVMVVVGAHFLLRCLDLEQFALYVVKEFEPLIQKPYSIVYFHSAASLQPQPDLGFMKRLQQILGRKHKKNLHAIYVLHPTLGLRTAILAMQLFVDGEVWKKVVYVDRLVQLFRYVPREQLTIPDFVFQHDLEVNGGKGIIIDPRTKHVYQRPSG

SEQ ID NO: 10193 - protein, 426 aa, Hordeum vulgare
MAKMTNAYDLPARKVIHTVGPKYAVKYHTAAESALSHCYRSCLELLVENGLESIAMGCIYTEAKNYPREPAAHVAIRTVRRFLEKQKDKITAVVFCTTSSTDTEIYKRLLPLYFPRDKQEEEIASLKLPADVGDENGEPIIDERKIRIKTLPAEAANSKYPVPVPADIPLSGSGLTRRRNSKLDSYLDPSFMSIIKDPDLRRKEQWEKSAQAKKGFNFAKLLGFGDLGGPALSAAEEYSLHQRYLAKANSLNLSEIAEMKIIYRGGVDSEGRPIMVVVGAHFLLRCLDLERFILYVVKEFEPLIQKPYSIVYFHSAASLQVQPDLGFMKRLQQMLGRKHQRNLQAIYVLHPTLGLRTAILALQLLVDGDVWKKVVYVDRLMQLFRYVPREQLTIPDFVFQHDLEVNGGKGIIVDPRTKHVYQRPSG

SEQ ID NO: 10194 - protein, 544 aa, Hordeum vulgare
VALDQVPRWSDPDQRFHSPSSPTAAGSEAPASSFLSFADPLDAAAAGGGHGACRFPVDPEVNSRIYLWRGHPWNLEVDAVVNSTNESLDEAHSSPGLHAAAGPELAEECATLGGCRTGMAKMTNAYDLPARKVIHTVGPKYAVKYHTAAESALSHCYRSCLELLVENGLESIAMGCIYTEAKNYPREPAAHVAIRTVRRFLEKQKDKITAVVFCTTSSTDTEIYKRLLPLYFPRDKQEEEIASLKLPADVGDENGEPIIDERKIRIKTLPAEAANSKYPVPVPADIPLSGSGLTRRRNSKLDSYLDPSFMSIIKDPDLRRKEQWEKSAQAKKGFNFAKLLGFGDLGGPALSAAEEYSLHQRYLAKANSLNLSEIAEMKIIYRGGVDSEGRPIMVVVGAHFLLRCLDLERFILYVVKEFEPLIQKPYSIVYFHSAASLQVQPDLGFMKRLQQMLGRKHQRNLQAIYVLHPTLGLRTAILALQLLVDGDVWKKVVYVDRLMQLFRYVPREQLTIPDFVFQHDLEVNGGKGIIVDPRTKHVYQRPSG

SEQ ID NO: 10195 - protein, 296 aa, Triticum aestivum
MIVKKQLTEDLKVLDQSTIPETNDEWINHTPSETTQMPETFAEEEQQEQEQQTIVIREAFTEEEEQRQQMIVKEHLTDGSDDHTTTSISTENLQDHKTHVVTCDSLTENQLLLMRLLVKDRYLLETAKAIVRVDAPVSFIDADAGAPNWSVDKGNNLLSDVAREVVRRKGKRSEAMEEVSVARTANLRLQYLDDLVRELDGDVESLDMSKSKRTQQQGDNRAAENLRRILESDIQNDHPDANSTWDFGWNRVWELPLEKGDVVRDLEKNILGGIITDVARDLIGVSVRHGCCPCVA

SEQ ID NO: 10196 - protein, 330 aa, Secale cereale
DEKINHTHSETTQIPAIFAEEEQQQQEQQRMIVKDQLTEDMKFLDQSAIPETNDEWINHTPSEAMQMPETFAEQEQQQQQQEQEHQTTVIPETFTEEEEHQQQMIVKEQLTDGSDDHTTSSISSENLQDHKTHVVACDSLTENQLLLMRLLVKDRYLLETAKAVVRVDAPVSFIDDEAGAPNWSDKGNDLLSDVAREVVRRKGKRSEAMEGVSVVRTANLRLRYLDDLVRELDGDVESLDMSKSKRTQQQQGDNRAAENLRRILESDIQNDHPDANSTWDFGWNRVWELPFEKGDVVRDLEKNILGGIITDVARDLIGVSVRHGCCPCVA

SEQ ID NO: 10197 - protein, 224 aa, Triticum aestivum
MIVKEQLTDGSDDHTTTSVSSENLQETHVVTCDSLTENQLMLMRLLVKDRYLLETAKAIVRVDAPVSFMDDVAGAPSWSDKGNDLLSDVAREVIRRKGKRSEAMEEVSVARTANLRLRYLDDLVRELDGDVESLDMSKSKRTQQQGDNRAAENLRRILESDIQNDHPDANSTWDFGWNRVWELPLEKGDVVRDLEKNILGGIITDVARDLIGVSVRHGCCPCVA

SEQ ID NO: 10198 - protein, 868 aa, Secale cereale
HAPGRLQVHEGAGSGLRGKENRKSSAAARSARIEEIVDEDSDAEQPKNASMQMVVHNKFQSHQTDQSTGRSSVMESGPSTSNINNSSEGEKDGSKVRMPSVIAKLMGLENLPSSSTTTAAERKGTERFVKPGAAPRMEIRGNTMDRKLPIRIIASEKGQHKIVLAGEWKNGLTNFGESELGAAAVSNSSSHPATATGNSKQGRLTMREVLRKMVAAETGADEKQEVEERNIHEDKGIAEEIKLQNSVSVGCRADSGKRMDFLKRFRKNSDNSRPVKEEKQSAQVKNAEVGKKQATGMRRLLGRDGEAKSRRAREKVNKENLATADTKAAGKNVKGDQVKRQAQSKHVDRQSKPRKPQSETPSRKLENKKKSLMPEAGHMKRKPEYTVVTQQEKEEQAKVNDAINFSKPADSTRGEGGLPEPLAIAVRRNLENKKSLMMPEAAHMRKKPEYTAVSQQESEEYTKVNETISLSKPADSARGDGGLSEPSVMVVSDSSRAGEASLDQPLQKITEGTSDHTVPVQTIVVQAMGDVEFLDHSAIVEINDEKINHTHSETTQIPAIFAEEEQQQQEQHQRQMIVKDQLTEDMKFLDQSAIPETNDERNNHTPSEATQMPETFAEEEQQQQQQEQQHQTIVIPETFIEEEEHQQQMIVKEQLTDGSDDHTTSSISSENLQDHKTHVVACDSLTENQLLLMRLLVKDRYLLETAKAVVRVDAPVSFIDDEAGAPNWSDKGNDLLSDVAREVIRRKGKRSEATEEVSVVRTANLRLRYLDDLVRELDGDVESLDMSKSKRTQQQQGDNRAAENLRRILESDIQNDHPDANSTWDFGWNRVWELPLEKGDVVRDLEKNILGGIITDVVRDLIGVSVRH

SEQ ID NO: 10199 - protein, 511 aa, Triticum aestivum
AASPGADRRHPHLKARQLRQRHGHGHRRIYFYLLAADSSPKYQPGQSCRKIRRKEPRLQAEGGDGKGNAAEGLEEGQAKSDCTDEQHDLDGEVGQDGRGSCGGSEYEKGGEMERVLENQAALIGQYEAQENAQREWEKKFNGSRDSTSDDVDRDNKLNQNGKTWGQRGRAAQIVNRELVGEEARSRDKRDLSGINSPSECLSNESAFGLSTNARNVSAIGKSEGSDNDFERATAVVASVVDELHARKDELVHKSYTKIIEGSGNNLGRSASSPQKGYHSSPNAVHNKGQGDGNSDSGSSYHGNARSYEHYVTTPSLGSPLSDTPKSKVSEWSSSCFHNHTDNQIDMQPPSSDDVGGVLEALQRAKMSLREKLGRASPPRQDMLALPAPEDHYTDDDLQVDDTELPLCMSQRLSQEILTLPASEDYLSRISLPGDDAKVPVGPAGLFRLPTDPFPQNEVCSTDGYGSRFSLTSSRQTVFSRNPASHIMLTSSRPQYGSGFSPNPYYDLHNSM

SEQ ID NO: 10200 - protein, 511 aa, Triticum aestivum
AASPGADRRHPHLKARQLRQRHGHGHRRIYFYLLAADSSPKYQPGQSCRKIRRKEPRLQAEGGDGKGNAAEGLEEGQAKSDCTDEQHDLDGEVGQDGRGSCGGSEYEKGGEMERVLENQAALIGQYEAQENAQREWEKKFNGSRDSTSDDVDRDNKLNQNGKAWGQRGRAAQIVNRELVGEEARSRDKRDLSGINSPSECLSNESAFGLSTNARNVSAIGKSEGSDNDFERATAVVASVVDELHARKDELVHKSYTKIIEGSGNNLGRSASSPQKGYHSSPNAVHNKGQGDGNSDSGSSYHGNARSYEHYVTTPSLGSPLSDTPKSKVSEWSSSCFHNHTDNQIDMQPPSSDDVGGVLEALQRAKMSLREKLGRASPPRQDMLALPAPEDHYTDDDLQVDDTELPLCMSQRLSQEILTLPASEDYLSRISLPGDDAKVPVGPAGLFRLPTDPFPQNEVCSTDGYGSRFSLTSSRQTVFSRNPASHIMLTSSRPQYGSGFSPNPYYDLHNSM

SEQ ID NO: 10201 - protein, 441 aa, Secale cereale
HRRSYFYLLAADSSPKYQPGQSCRKIRRKEPRLQTEGGEGKGNAAEGLEEDQGKSDCTDEQHDLDGEAGRDGRGSCGGSEYEKGGEMERVLENQAALIGQYEAQENAQREWEKKFNGSRDSTSDDVGRDNKLNQNEKAWGQRGRAAQIMKKDLSGINSRSECLLNESAFGFSTNAPNVSAIGKCEGPDNDFERATAVVASVDDELRARKDELVHKSYTETIEASGNNLGRSASSPQKSYHSSPNAVHNKGQGDGNSDSGSSYHGNARSYEHYITTPSLGSPLSDTPKSKVSEWSSSCFHNHTDNQIDMQSPASDDVGGVLAALQRAKMSLREKLGRASPPRQDMLALPAPEDHYTDDDLQVNNTELPLCISQRLSQEILALPASEDYLSRISLPGDDAKVPVAPPGLFRLPTDSFPQNEVCSADGYGSKFSLYIKSADRLF

SEQ ID NO: 10202 - protein, 434 aa, Secale cereale
KGVFRLKASPASGAAVHVQGAPAGVDVKVMDLQVFATDRKARFKKLRKKTDKVRRRDVVLKFAGAGASSAVSGASIRVMQMDTSFAFGACINPAVIQEPAFVDYFTKHFDWAVFENELKWYHTEAVQGQLNYADPDALLDFCDRHGKPVRGHCIFWAVDRMVQKWVKDLPNDQLTAAVQGRLTSLLTRYAGRFPHYDVNNEMLHGSFFQDRLGDDINAFMFKETQDDPGAASSSTTTTSRAAATQRHPGEVHRAGQRAHGEGGARGRHRAAGARHQPRRRDHLRRARQARHHRPARLAHRAGRVRVRRLPPRRGPRGGAPGGVRAPGRRGRRALGVHAGAHVAPGRLPRQLRRHHQRRRPKVHQPAAGVDVARARQDRQRRQLQVQGVPRLVRRAARHGHGEDAQGLQRREGGHTSRARHGRVTTVNYYGYYLV

SEQ ID NO: 10203 - protein, 582 aa, Brachypodium distachyon
MACCAAQHEVVFDANLIKNSTLEDGLAGWAPLGACTKLSARVEEPAMVPTESINEDYKPSGRYILASSRECQEDGLCQPIPASALKPRVTYRVAGWISLGAGCADNGDAVTDAVVRVNIRLDGNGVGDEDKEGGKKKCSVVEGGVVCAEAGKWTELKGAFRLKACPAAGAMVHVQGAPPGVDVKVMDLQVFATDRKARFKKLKKKTDKVRRRDVVLKFGGAGSGSASAISGASIRVMQMDTSFAFGACINPAVIQDQGFVDFFTKHFDWAVFENELKWYHTEPAQGQLNYADTDALLDFCDAHGKPVRGHCIFWAVDNVVQQWVKALDKDGLNAAVQARLNSLLTRYAGRFPHYDVNNEMLHGSFFQTRLGDDINAFMFKETARIDPGATLFVNDYNVEGGMDPNATPEKYIAQINALQEKGAPVGGIGLQGHVTNPVGEVVCDALDKLATTDLPIWLTELDVCESDVDLRAEDLEVVLREAYAHPGVEGVIFWGFMQGHMWRQDACLVNADGTVNDAGERFIDLRREWTSHARGKIDSDGHFKFRGYHGSYVVQLSTATGKMHKTFSVEKGDTPLVLDMDV

SEQ ID NO: 10204 - protein, 557 aa, Oryza sativa
MACTKGVVFDVNLLENSTLEDGLAGWAAVGECTALSVHNEEPEKVPTETINTVADDYKPSGRYILAAGRAGEEDGLRRAVAGALKPRVTYRVAGWISLGDGAEGSHPVRVNLRLDDDDECVVEGGAVCAQAGRWTEIKGAFRLKASPCGATVFVQGAPDGVDVKVMDLQIFATDRRARFRKLRKKTDKVRKRDVVLKFGGAGSISGASVRVMQMDSSFPFGACINGGVIQNPAFVDFFTKHFDWAVFENELKWYWTEAQQGQLNYADADALLDFCDRYGKPVRGHCIFWAVDNVVQQWIKGLDHDQLTAAVQGRLTGLLTRYAGRFPHYDVNNEMLHGSFYQDRLGDDINAFMFRETARLDPGATLFVNDYNVEGGNDPNATPEKYIEQITALQQKGAAVGGIGLQGHVTNPVGEVICDALDKLATTDLPVWLTELDVCESDVDLRADDLEVVLREAYAHPAVEGVMFWGFMQGHMWRQDACLVNSDGTVNDAGERFIDLRREWTSHARGHIDGDGHFKFRGFHGTYVVQLATATGKMHKTFTVEKGDTPLVLDMDV

SEQ ID NO: 10205 - protein, 564 aa, Setaria italica
MACTQEVVFDVNLIENSALEDGLAGWAPVGSCTALSVHEEEPAKVPTETINDVAEDYRPSGRYILASGRADETDGLRQAIKGALKPRVTYRVSGWISLGGGAATTAEEGAGGHAVCVNLRLDDECVVKGGAVCAEVGRWTEIKGAFRLKKSPCAAAVYVQGAPAGVDVKVMDLQVYATDRRARFRKLRRKTDKVRKRDVVLNFGSAASGISGASVRVFQMDSSFPFGACINPSVIQNPAFVDFFTKHFDWAVFENELKWYHTEAQQGQLNYADSDALLDFCDQHGKPVRGHCIFWAVENTVQQWVKNLDDDQLKSAVQERLQSLLTRYAGRFPHYDVNNEMLHGSYYRSRLGDDIDAFMFRETARLDPGATLFVNDYNVEGGSDPNATPEKYIEQIAALQQKGAAVGGIGLQGHVTNPVGEVICDALDKLSAATDLPVWLTELDVCESDVDLRAEDLEVVLREAYAHPAVEGVVFWGFMQGHMWRQDACLVNSDGTVNDAGERFVDLRREWTSHARGHIDSAGHFKFRGYHGSYVVQLATATGKVHKTFSVEKGDTPLVLDMNL

SEQ ID NO: 10206 - protein, 214 aa, Pennisetum glaucum
FGTLLRFGGAVETARLDPGATLFVNDYNVEGGNDPNATPEKYIEQIAALQQKGAAVGGIGLQGHVTNPVGEVICDALDKLSAATDLPVWLTELDVCESDVDLRAEDLEVVLREAYAHPAVEGVVFWGFMQGHMWRQDACLVNSDGTVNDAGERFVDLRREWTSHARGHIDSAGHFKFRGYHGSYIVQLATATGKVHKTFSVEKGDTPLVLDMDL

SEQ ID NO: 10207 - protein, 372 aa, Panicum virgatum
VRKRDVVLNFGSAAASGISGASVRVMQMDSSFPFGACINPAVIQNPAFVDFFTKHFDWAVFENELKWYHTEAQQGQLNYADSDALLDFCDRYGKPVRGHCIFWAVENTVQQWVKSLDKDQLTAAVQARLQSLLTRYAGRFPHYDVNNEMLHGSFYRDRLGDDVDAFMFREAARLDPGAALFVNDYNVEGGNDPNATPEKYIEQIAALQQKGAPVGGIGLQGHVTNPVGEVICDALDKLSAATDLPVWLTELDVCESDVDLRADDLEVVLREAYAHPAVEGVVFWGFMQGHMWRQDACLVNSDGTVNDAGERFVDLRREWTSHARGHIDSAGHFKFRGYHGTYVVQLATATGKVHKTFSVEKGDTPLVLDMNI

SEQ ID NO: 10208 - protein, 216 aa, Panicum virgatum
MACTQEVMFDLNLIENSALEDGLAGWSPVGSCTALSVHEEEPAKVPTETINDVGEDYRPSGRYILASGRADEADGMRQAIKGALKPRVTYRVAGWISLGGAAAADAEGAGHAVRVNLRLDDDECVVEGGAVCAEVGKWAEIKGAFRLKKSPRAAAVYVQGAPAGVDVKVMDLQVFATDRKARFTKLRGRLTRCASATWSSTSAARRRRASPARPCG

SEQ ID NO: 10209 - protein, 461 aa, Panicum virgatum
MACTQEVVFDLNLIENSALEDGLAGWAPVGSCTALSVHEEEPAKVPTETINDVGEDYRPSGRYILASGRADEADGLRQAIKGALKPRVTYRVSGWISLGGGGAAEGAGHAVRVNLRVDDECVVEGGAVCAEAGKWAEIKGAFRLKKSPRAAAVYVQGAPAGVDVKVMDLQVFATDRKARFRKLRRKTDKVRKRDVVLNFGGAAASGISGASVRVMQMDSSFPFGACINPSVIQNPAFVDFFTKHFDWAVFENELKWYHTEAQQGQLNYVDSDALLDFCDRYGKPVRGHCIFWAVENTVQQWVKSLDKDQLTAAVQGRLQSLLTRYAGRFPHYDVNNEMLHGSFYRDRLGDDIDAFMFREAARLDPGAALFVNDYNVEGGNDPNATPEKYIEQIAALQQKGAPVGGIGLQGHVTNPVGEVICDALDKLSAATDLPVWLTELDVCESDVDLRADDLEVVLREA

SEQ ID NO: 10210 - protein, 564 aa, Sorghum bicolor
MACTQGVLFDVNLIENSALEDGLSGWSPVGTCTALSVVEEEPAKVPTETINDVADGYRPSGRYILASGRADEADGLRRPIAAAALIKPRVTYRVAGWIALGGDGATAGDSHAVRVNLRLDDDDGCVVEGGAVCAEPGKWTEIKGAFRLKKSPCAAEVYVQGAPPGVDVKVMDLQVFATDRKARFRKLRKKTDKVRKRDVVLNFGSAAASGISGASIRVMQMDSSFPFGTCINTNVIQNPAFVDFFTKHFDWAVFENELKWYHTEAQQGQLNYADSDALLDFCDRYGKPVRGHCIFWAVENTVQQWVKSLDADGLTAAVQERLTSLLTRYAGRFPHYDVNNEMLHGSYYQDRLGDDINAFMFRETARLDPGATLFVNDYNVEGGNDPNATPDKYIAQIAALQQKGAAVGGIGLQGHVTNPVGEVICDALDKLATTDLPVWLTELDVSESDVDLRAEDLEVVLREAYAHPAVEGVMFWGLMQGHMWRQDACLINADGTVNDAGERFVDLRREWTSHARGHIDSAGHFKFRGYHGTYVVQLATATGKVHKTFSVEKGDTPLVLDMNL

SEQ ID NO: 10211 - protein, 321 aa, Sorghum bicolor
MPRSSAGASCTAIDHSEQNTKDDEYERLVIRAQHETSGTAILSEQTKSRSFIWWMKVLLGCFLLILVGYVFVKWGVPFAFEKVLVPIMQWEASAFGRPVLAVVLVASLALFPVILVPSGPSMWLAGMIFGYGWGFLIIMVGTTIGMVVPYWIGSLFRERLHVWLAKWPQQIALIKLAGEGNWFQQFRVVALFRISPFPYTIFNYAVTVTEIKFNPYLCGSVAGMIPEAFIYIYSGRLIRTLADMKYGNYKMTPVEIAYNAISLVIAIVLTVAFTVYAKRALNDIESSDGITKEDHSPNGSGARVSHRQERADARSIQLDVV

SEQ ID NO: 10212 - protein, 324 aa, Setaria italica
MPSSSAGASCAAVDHSEQNTKDDEYARLVTRAQHATSDVSATILPEQPRSRSFIWWMKVLLGCFLLIIVGYVFVKWGVPFAFEKVLLPIMQWEASAFGRPVLAVVLVASLALFPVILVPSGPSMWLAGMIFGYGWGFLIIMVGTTIGMVVPYWIGSLFRERLHVWLTKWPQQIALIKLAGEGNWFQQFRVVALFRISPFPYTIFNYAVTVTEIKFNPYLCGSIAGMVPEAFIYIYSGRLIRTLADMKYGNYKMTPVEITYNVISFIIAIVLTVAFTVYAKRALNNIKSSEGICKEEVLSPAGSGARLKHHQERSGSCSVELDVV

SEQ ID NO: 10213 - protein, 323 aa, Pennisetum glaucum
MPSSSGASCAAVDHSDHNTKDDEYARLVTRAQHATSDVSATTLPEQPRSRSFIWWMKVLLGCFLLILVSYVFVKWGAPFAFEKVLVPTMQWEASAFGRPVLAVVLVASLALFPVILVPSAPSMWLAGMIFGYGWGFLIIMVGTTIGMVVPYWIGSLFRERLHVWLMKWPQQMALIKLAGEGNWFQQFRVVALFRMSPFPYTIFNYAVTVTEMKFNPYLCGSIAGMVPEAFLYIYSGRLIRTLADMKYANYKMTPVEIAYNVISFIIAIVLTVAFTVYAKRALNDIKSSEGIYKEEVPGPAFSGARSKHHQERSGSYPVELDVV

SEQ ID NO: 10214 - protein, 460 aa, Saccharum officinarum
IYAADFANDFLLSYNHSYDPLAEYLSFIDNDVFSVDGVLTDFPVTASEAIGCFTNLNKSNTDHGKPLIISHNGASGDYPGCTDLAYQKAVDDGADVIDCPVQVTKDGIPICMSSIDLMTYTTVARSQFISQTATIKDIQIAPGVFSFNLTWDDIVKNLKPKISTPWTDFALDRNPRYRNAGKFMRLSDFLDFTKDKDLSGIMISVEHAAFMAGELGFDMVDKVIKALDDAGYHDQTAQKVMIQSTDSSVLEKFKEQTKYDLVYMINKEVGDAAPSSLADIKKFASAVSVDTSSVFPETHYFTVYETNLVQTLQTAGLSVYVYTLMNEFPSQPYDFFSDATAQINAYVKGALVDGLITDFPATARRYKLNNCMNMGNSTPKYMAPAHAGDLMQSISKSAQPPALAPIPPLTESDVAQPPLPPARSNSTAPTQSPASRTHACAAHIPILITLAMLCAWRSLA

SEQ ID NO: 10215 - protein, 1244 aa, Zea mays
METTEAAAAHPQKDSVKVAVNIRPLITVELQDGCTDCVTVTQGEPQVQIGPHVFTFDHVYGSSGPSSSLIFEQCVHPLIDALFSGYNATVLAYGQTGSGKTYTMGTNYSGEENCGGIIPQVMDTIFRKVDTSKDGSEFLIRVSFIEIFKEDVFDLLDANQAAVRLDAGSMAKASAPGRVPIQIRETATGGIILAGVTEAEVKSKEEMASYLTRGSSSRATASTNMNMQSSRSHAIFTICVEQKRTSGTSDKSASSDYDILSSKFHLVDLAGSERAKRTGADGHRLKEGIHINKGLLALGNVISALGDEKKRKEGAFVPYRDSKLTRLLQDSLGGNSKTVMIACISPADINAEETINTLKYANRARNIQNKAVVNRDPATAEMQKLRSQLEQLQTELLFSRSGSAALEELQLLQKKVSLLELKTSELNNELKEKELSCEQLAERAQAAQLERDQLMLKIESVRNGKSLDDIENIDNDQDMDLLKGYISKIQQLESALMRQNFSNACRHGLHDQLAMDQDIFLNELGSGCEVETTDASNEVDEEEKEREHSFMQDQLDKELQELDKRLQQKEAEMKQFAKSDTSVLKQHYEKKLTDLEQEKKALQKEIENLRHALTNISSSMDDNAQKVKENYLQKLNALESQVHELKKKQEAQQQLLRQKQRSDEAAKRLQEDIQRIKSQKVQLQQKIKQESEQFRSWKAAREKEVLQLKKEGRRNEYEMHKLLALNQRQKMVLQRKTEEAAAATKRLKELLEAKKSSRETYGSANGSGMQALIRAIDDELEVTVRAHELRSYYERQMQERAAISKEIAKLKEESKHKISDCPQAMSPSARSSRISALENMLSSSSSAMVSMASQLSEAEERERVFNGKGRWYHVRSLPEAKNIMNYLFQLASSARSQVLDKEVICNEKEHTITELKEKVVVLNGGIRQLETQVRDLRSQNTQLFTALNNAKKSARSNGTGFAGRKSVRSSQHFGYSKDNFNWVDDMDISDSEHSDELENMSDGSDSDWVQSTRKAKKHQRRVSSHSNPNLDCQNTQGSAEPEKPSDEKCILPKYISSDGCSCSKSSSCKTNKCECRGSGAQCGAGCGCKDSKCSNRDSSTIEKANQGAMLLQTAFSEKEAQDAKPRKPLTNIGNNVVNQTAETKKPRKNRRKSAIQLVPGPLLPSEPVATEAAPRDIANIPLKLPRAMSSVTPAESNPPLTDRNAAKPDESVSTGSKNSTGAAATRAPSQLRKNATTEKENQLR

SEQ ID NO: 10216 - protein, 1253 aa, Setaria italica
METPEAAAAHQQKDSVKVAVNIRPLITMELQDGCTDCVTVTPGEPQVQIGPHVFTFDHVYGNSGPSSSFIFEQCVRPLIDALFSGYNATVLAYGQTGSGKTYTMGTDYSGEGNCGGIIPQVMETIFRKVEASKDGTEFLIRVSFIEIFKEEVFDLLDSNHAAARLDSVSVAKPSAPARVPIQIRETATGGITLAGVTEAEVKSKEEMASYLIRGSSSRATASTNMNRQSSRSHAIFTICVEQKRTSGISDKSASSDYDILSSKFHLVDLAGSERAKRTGADGHRLKEGIHINKGLLALGNVISALGDEKKRKEGAFVPYRDSKLTRLLQDSLGGNSKTVMIACISPADINAEETINTLKYANRARNIQNKAVVNRDPATAEMQKLRSQLEQLQTELLFSRSGSAALEELQLLQKKVSLLELKNSELNHELKERDLSCEQLAERARAAQLERDQLMLKIASARNGKSWDDIENADNGQDVDLLKSYISKIQQLESELMRQNFSNGCRHGLHDQLTMERDILLNDLGSEGEVGTPDASSEVDEEEKEREHSSMQDQLDKELQELDKRLQQKEAEMKQFAKSDTSVLKQHYEKKLNELEQEKKALQKEIENLRHALTNISSSTDESAQKLKENYIQKLNALESQVSELKKKQEAQQQLLRQKQKSDEAAKRLQEDIQRIKSQKVQLQQKIKQESEQFRSWKAAREKEVLQLKKEGRRNEYEMHKLLALNQRQKMVLQRKTEEAAAATKRLKELLEAKKSSRETYGGANGSGMQAVMRAIDDELEVTVRAHELRSYYERQMQERAAISKEIAKLKEESKHKMSDCPQAMSPSARSSRISALENMLSSSSSAMVSMASQLSEAEERERLFNGKGRWHHVRSLPEAKNIMNYLFQLVSSARCQVQDKDATCNEKEHIISELKEKVVVLNSGIRQLEMQVKDLGHQNMQLFTALNNAKKSAISSGNSTGVSDDGQTYALRKSVRSSQYFGYSKNHFNWLDDMDTSDSDYSEEDKMSEESDGDWVKPTRKVRKHRQTVSSHASLNLGCQNTQENAEPEKKPTDEKCILPKDVPSECCSCSKFSSCKTNKCECRGSGAHCGPGCGCKDSKCSNRDSSDNTEIVNQGIMLLENAFSEKDAQDAKTRKPLADIGNNEVNQTAETKKKPRKNWRKSTVQLVTVPLPPSVPETTEAAPRDRADIPLKLPRAMSSASAESNPPPLTDRNAAKPDESVSTGTKESTAATRPPSQLRKNAATEKENQLR

SEQ ID NO: 10217 - protein, 343 aa, Ambrosia trifida
MCLLLVPFIFFHLLPATIPAVAPPLHPGYYAKSCPNAEYIVRDVLKKAMIREPRSGASVMRFQFHDCFVNGCDGSMLLDDTPTMLGEKLSLSNIDSLRSYEVVDEIKEALETACPQTVSCADIIIMASRDAVALSGGPDWEVKLGRKDSLTASQEDADAIMPSPRANATMLIDLFAKFDLSVKDLVALSGSHSIGKGRCFSIVFRLYNQSGTGRPDPSIEPKFRQKLNKLCPLGGDGNVTGDLDFTPRVFDNQYFKDLVSGRGFLNSDETLYTYWRTREYVKRYSEDQDEFFRDFVEGMIKMGDLQSGRPGEIRKNCRVVNGGPPVDLVVEGYKDRRILSYET

SEQ ID NO: 10218 - protein, 304 aa, Flaveria ramosissima
LLCLPPATVAAASAAPPLRPAYYSQTCPNAELIVRNTLKKAMIRDPRSGASVMRFQFHDCFVNGCDGSMLLDDTPTMLGEKLSLSNINSLRSYEVVDEIKEALESACPMVVSCADIIIMASRDAVALSGGPDWEVKLGRKDSLTASQKDADDIMPSPRANASTLIDLFAKFDLSVKDLVALSGSHSIGKGRCFSIVFRLYNQSGTGRPDPTIEPKYREKLDKLCPLGGDGNVTGNLDFTPYIFDNQYFKDLVHGRGFLNSDETLYTYWKTREYVKRYGEDQEEFFRDFVEGMDKDGGLAFGAAR

SEQ ID NO: 10219 - protein, 338 aa, Lactuca sativa
MCLLSFVLCLLPVVISAAAPPLQPGYYAKSCPNAELIVRDVMKKAMIREPRSGASVMRLQFHDCFVNGCDGSLLLDDTPTMLGEKLSLSNINSLRSYEVVDEIKEALESACPRIVSCADIIIMASRDAVALSGGPDWEVKLGRKDSLTASQKDSDDIMPSPRANASSLIDLFARFDLSVKDLVSLSGSHSIGNGRCFSIVFRLYNQSGTGRPDPTIEPKFRKKLDKLCPLGGDGNVTGDLDFTPHVFDNQYFKDLVNGRGFLNSDETLFTFPETRGYVRRYSEDESEFFRDFVDGMIKMGDLQSGRPGEIRRNCRVVNDPPQVEVVVGEFRDRKILSK

SEQ ID NO: 10220 - protein, 258 aa, Artemisia annua
MLGEKLSLSNINSLRSYEVVDEIKEALETACPQIVSCADIIIMASRDAVALSGGPDWEVKLGRKDSLTASQKDSDDIMPSPRANASTLIDLFAKFDLSIKDLVALSGSHSIGNGRCFSIVHRLYNQTDDGRPDPSIEPRYRQKLDKLCPLGGDEEVIGDLDFTPRVFDNQYFKDLVHGRGFLNSDETLYTFWQTRGYVQRYSENPSAFFKDFVEGMIKMGDLQSGRPGEIRKNCRVVNDAPPMEIVMRGSKDRKILSF

SEQ ID NO: 10221 - protein, 276 aa, Cirsium arvense
FLFSPLPITISAVAPPLVPEYYAKSCPNAELIVRDVMKNAMAREPRSGASVMRLQFHDCFVNGCDGSLLLDDTPTMLGEKLSLSNINSLRSYEVVDEIKEALEKACPRTVSCADIIIMASRDAVFLSGGPNWDVKLGRKDSLTASQEDADDIMPSPRANASMLIDLFARFDLSVKDLVALSGSHSIGKGRCFSIVFRLYNQSGTGRPDPTIEPRFRQKLDKLCPLGGDGNVTGGLDFTPQVFDNQYFKDLVNGHGFLNSDESLFSFLENETVCSEV

SEQ ID NO: 10222 - protein, 329 aa, Cirsium arvense
VSSSSSSLVSTSGDHLRRIATTPAGILRQIMSKCRAHRQRRHEKAMSREPRSGASVMRLQFHDCFVNGCDGSLLLDDTPTMLGEKLSLSNINSLRSYEVIDEIKEALETACPHTVSCADIIIMASRDAVLLSGGPNWDVKLGRKDSLTASQQDSDDIMPSPRANASMLIDLFAKFDLSVKDLVALSGSHSIGKGRCFSIVFRLYNQSGTGQPDPTIEPMFRKKLNKLCPLGGDGNVTGGLDFTPQVFDNQYFKDLVNGHGFLNSDESLFTYFKTRPYVRRYSEDELEFFRVFCGGDDKIGGRCNPGGRGRFVGIAGWLMGRRWMWWLGD

SEQ ID NO: 10223 - protein, 324 aa, Flaveria ramosissima
APPLRPAYYAQTCPNAELIVRNAVKNAMIRDPRSGASVMRFQFHDCFVNGCDGSMLLDDTPMMLGEKLSLSNINSLRSYEVIDEIKEALESACPMVVSCADIIIMASRDAVALSGGPDWEVKLGRKDSLTASQKDADDIMPSPRADARTLIDLFAKFDLSVKDLVALSGSHSIGKGRCFSIVFRLYNQSGTGRPDPTIEPKYRQKLDKLCPLGGDGNVTGNLDFTPYIFDNQYFKDLVHGRGFLNSDETLYTYWETREYVKRYSEDQEEFFRDFVEGMIKMGNLQSGRPGEIRRNCRVVNDGPPVDLVLEGFKDRENIEFLNYI

SEQ ID NO: 10224 - protein, 665 aa, Nicotiana benthamiana
MKSRFGTPFEGIAEDIRGRVSCYKQDWIAGIRSGIGILAPTTYIFFASALPVIAFGEQLSRDTDGSLSTVETLASTAICGIIHSIFGGQPLMILGVAEPTIIMYSYLYNFAKGREELGQTLYLAWAGWVCVWTALILFLLAIFNACSIISKFTRIAGETFGMLIAVLFIQEAIKGLVSEFHIPKSDDPSSEKNQFHWLYTNGLLGIIFTFGLLYTASKSRKARSWWYGTGWIRSFIADYGVPLMVIMWSALSFIVPNKVPSGIPRTLYSPLPWESASLYHWTVMKDMGKVPPAYIFAAIIPAVMIAGLYFFDHSVASQMAQQKEFNLNNPSAYHYDILLLGFMTLLCGLIGLPPSNGVLPQSPMHTKSLAILKKQLIRKKMVESAKESIRRKASNSEIYGNMQAVFIEIDSSPVSAVAKELKHLKEAIMKHEIENANGGKSNGKFDPEKHIDAYLPVRVNEQRVSNLLQSLLVAASVCAMPVIKKIPTSVLWGYFAYMAIDSLSGNQLWERILLLFITPGRRFKVLEGVHASFVESVPFRCMAIFTVFQLVYLLVIFGVTWIPIAGILFPLPFFLLLSIRQHLLPKLFHPRHLQELDAAEYEEIAGTPKRALSFSFRETEITLPGTEEGKIEICDAETLDELTTSRGELKFRTVSFSDDKRPQVP

SEQ ID NO: 10225 - protein, 134 aa, Triticum aestivum
MAGDGDEELPAMGGDKLILRGLQFHGFHGVKQEEKKLGQKFVVDVDAWMDLAAAGDSDDIAHTVSYTDIYRIAKGVVEGPSRNLLESVAQSIAGTTLLEFPQISAVRVKVGKPHVAVQGVVDYLGVEILRRREA

SEQ ID NO: 10226 - protein, 135 aa, Secale cereale
MAGDGEDELPAMGGDKLILRGLQFHGFHGVKQEEKKLGQKFTVDVDAWMDLAAAGDSDDIAHTVSYTDIYRIAKGVVEGPSRNLLESVAQAIAGSTLLRFPQISAVRVKVGKPHVAVQGVVDYLGVEILRRRREA

SEQ ID NO: 10227 - protein, 136 aa, Secale cereale
MAGDGEDELPAMGGDKLILRGLQFHGFHGVKQEEKKLGQKFTVDVDAWMDLAAAGDSDDIAHTVSYTDIYRIAKGVVEGPSRNLLESVAQAIAGSTLLQFPQISAVRVKVGKPHVAVQGVVDYLGVEILRRRREAP

SEQ ID NO: 10228 - protein, 136 aa, Secale cereale
MAGDGEDELPAMGGDKLILRGLQFHGFHGVKQEEKKLGQKFTVDVDAWMDLAAAGDSDDIAHTVSYTDIYRIAKGVVEGPSRNLLESVAQAIAGSTLLQFPQISAVWVKVGKPHVAVQGVVDYLGVEILRRRGEAP

SEQ ID NO: 10229 - protein, 914 aa, Hordeum vulgare
MAAAAASVGHSRGGGGRIHRLEVENFKSYKGTQTIGPFFDFTAIIGPNGAGKSNLMDAISFVLGVRSAHLRGAQLKDLIYALDDRDKEAKGRRASVRLVYNLPSTGGELHFTRTITGAGGSEYRIDGRLVTWDDYNAKLRSLGILVKARNFLVFQGDVESIASKNPKELTALLEQIAGSDELRREYDGLEEQKTSAEEKSALVYQEKRTIVMERKQKKAQKEEAEKHLRLQQDLKLLKTEHLLWQLYSIEKDMEKIEAELEDERHSLQQAREDNQSSDNGLAAKKKEQSAFLKKITLCEKSMAKKKIDMDKKQPELLRLKEQISRLKSKIKSCNKEIDKKKDDNKKHLEEMKRLQSALADVTSAIEDLNEQGQDKGVKLQLADDQVQEYHRIKEDAGMRTAKLRDEKEVLDKELNADIEAKKNLEENMQQLRSRVDEISSQESELQTKLSKILHSIPKHEDELTNLREDHNKIAKERQSSGAKYQMLKQKVDEIDTQLRELKAVKHESERDARFSETVKSLKRLFPGVHGRMTELCRPSQKKYNLAVTVAMGKFMDAVVVEDESTGKECIKYLKEQRLPPQTFIPLQSIRVKPITERLRTLGGSAQLIFDVIQFDRALEKAVLYAVGNTLVCDKLDEAKTLSWSGERYKVVTVDGILLTKSGTMTGGVSGGMEARSNKWDDSRIESLKKKKSKLESEMSELGSPRELQRKELAVSEKITGLEKKLHYSNVEQNNLKEKLHKLASEKRNIEKEIDHLEPGKEELESRLAKNEREVRKREKKINEIVDRIYKDFSTSVGVKNIREYEEKQLKDAQALQERKLSLSNQLSKLKYQLEYEQKRDMHAPIAKLNNTHETLEKELKGLQERETHAKADAEHISNQMEELKAEAEGTLPKHVVCFSVVLDKDAIGVGCVEL

SEQ ID NO: 10230 - protein, 621 aa, Brachypodium distachyon
MAAAPSDGHSRRSGGGRIHRLEVENFKSYKGTQTIGPFFDFTAIIGPNGAGKSNLMDAISFVLGVRSAHLRGAQLKDLIYALDDRDKEAKGRRASVRLVYNLPSTGAELHFSRTITGAGGSEYRIDGRVVTWDDYNAKLRSLGILVKARNFLVFQGDVESIASKNPKELTALLEQIAGSDELRREYDETEDLKTRAEEKSALVYQEKRTIVMERKQKKAQKEEAEKHLRLQQDLKVLKTEHLLWQLYTIENDMEKIEAELEEGRQSLQQVREENQSSDHELAAKKKEQSAFLKKMTLCEKSMAKKKLDIDKKQPELLRLKEQISRLKSKMKSCNKEIDKKKDDSKKHLEEMKRLHSALVDVTRAIEELNEQGQDKSVKLQLADDQVQEYHRIKEDAGMRTAKLRDEKEVLDKELNADVEAKKNLEENMQQLRSRVDEISSQESELHTRLNKILNSIPKHEDELTRLREEHNKIAKERQSSGAKYQTLKQRVDEIDTQLRELKADKHEGERDARFSETVRSLKRLFPGVHGRMTELCRPAQKKYNLAVTVAMGKFMDAVVVEDESTGKECIKYLKEQRLPPQTFIPLQSVRVKPIIEKLRTLGGSAQLIFDVIQYPFFFPVS

SEQ ID NO: 10231 - protein, 321 aa, Avena sativa
MAAASATPCGHGSRAVGGRIHRLEVENFKSYKGTQTIGPFYDFTAIIGPNGAGKSNLMDAISFVLGVRSAHLRGAQLKDLIYALDDRDKEERGRRASVRLVYNLPGTGAELQFTRAITGAGGSEYRIDGRVVTWDDYNAKLRSLGILVKARNFLVFQGDVESIASKNPKELTALLEQIAASDELKREYEDLEKQKTTAEEKSALVYQEKRTIVMERKQKKAQKEEAEKHLRLQQDLKLLKTEHLLWQLYSIEKDMEKIEAELEEERGSLQQAREENQSSENELTAKKKEQSAFLKKITLCEKNMAKKKLDIDKKQPELLKL

SEQ ID NO: 10232 - protein, 455 aa, Panicum virgatum
  misc_feature (4)..(4): Xaa can be any naturally occurring amino acid
  misc_feature (95)..(95): Xaa can be any naturally occurring amino acid
  misc_feature (134)..(134): Xaa can be any naturally occurring amino acid
  misc_feature (384)..(384): Xaa can be any naturally occurring amino acid
  misc_feature (432)..(432): Xaa can be any naturally occurring amino acid
  misc_feature (453)..(453): Xaa can be any naturally occurring amino acid
MAAXDGRSSDGGGGRIHRLEVENFKSYKGTQTIGPFFDFTAIIGPNGAGKSNLMDAISFVLGMRTVQLRGAQLKDLIYALDDRDKEAKGRRASVXLVYRQPNQEELHFTRTITGAGGSEYRIDGRLVTWDEYNXKLRSLGILVKARNFLVFQGDVESIASKNPKELTALLEQISGSDELRREYDELEEQKARAEENSALVYQEKRTIVMERKQKKAQKEEAEMHLRLQQDLKLLKTEHSLWQLYTIEKDREKMEAELAEDRESLQQVQEENQSAENELTAKKKEQSAFLKKMTLCEKSIAKKKLELDKKHPELLKLKEQISRLKSKIKSCKKEIDKKKDDNKKHLEEMRRLQSALVDVTKAIEELNEQGQDKSGKLQLADDQLXEYHRIKEDAGMKTAKLRDEKEVIDKKLNADVEAKKNLEENMQQLRSRXDEISSQETELQTDLTDSSFHXQT

SEQ ID NO: 10233 - protein, 621 aa, Panicum virgatum
MAAVDGRSGDNLARGDGGGGRIHRLEVENFKSYKGTQTIGPFFDFTAIIGPNGAGKSNLMDAISFVLGVRSAHLRGAQLKDLIYALDDRDKEAKGRRASVRLVYRQPNQEELHFSRTITGAGGSEYRIDGRLVTWDEYNGKLRSLGILVKARNFLVFQGDVESIASKNPKELTALLEQISGSDELRREYDELEEEKARAEENSALVYQEKRTIVMERKQKKAQKEEAEMHLRLQQDLKLLKTEHSLWQLYTIEKDREKMEAELAEDRESLQQVQEENQSAENELTAKKKEQSAFLKKMTLCEKSIAKKKLELDKKHPELLKLKEQISRLKSKIKSCKKEIDKKKDDNKKHLEEMRRLQSALVDVTKAIEELNEQGQDKSGKLQLADDQLREYHRIKEDAGMKTAKLRDEKEVIDKKLNADVEAKKNLEENMQQLCSRMDEISSQETELQTRLDKILHSIPKHENELAHLREEHTRIAKERQSSGSRYQTLKQRVDEIDTQLRELKADKHESERDARLKETVGSLKRLFPGVHGRMHELCRPSQKKYNLAVTVAMGKFMDAVVVEDENTGKECIKVLLHDFLLSNYSTFFLVLVYIEPMYRGPSRGPCIGTIYPTLLGFGGI

SEQ ID NO: 10234 - protein, 395 aa, Zea mays
MAAADGRSGDFRVRGGSVGGRIDRLVVENFKSYKGEQTIGPFVDFTAIIGPNGAGKSNLMDAISFVLGVRSTHLRGAQLKDLIYALDDRDKEAKGRKASVRLFYCQPNQEELCFTRSITGAGGSEYRIDRNQVTWDVYNAKLRSLGILVKARNFLVFQGDVESIASKNPKELTALLEQISGSDELRREYDELEEQKARAEEKSALVYQEKRTIVMERKQKKVQKEEAEKHLRLQQDLKLLKTEHYLWQLYTIEKDIEKIEAELVEDRESLQQVQEENRSSDYELTAKKKEQSAFLKKITLSEKSITKKKLELDKKQPELLKLKEQISRLKSKIKSCKKEIDKKKDDHKKHLGELRRLQSDLVEVTEAIEELNEQGQDTSGKLLLADDQLQEYHRM

SEQ ID NO: 10235 - protein, 314 aa, Arabidopsis lyrata
MAVSCNHSAILFSPSTAGSSSVSSSSSLIGLPRFQTLRFKSRSLYSKSRVSPVSALPSRSLEALIFDCDGVILESENLHRQAYNDAFSHFDVRCPPSSSESLNWSLEFYDKFQNLVGGGKPKMRWYFKENGWPTSTIFESPPENDDDRAKLIDTLQDWKTERYKEIIKSGSVEPRPGVIRLMDEAKAAGKKLAVCSAATKSSVILCLENLIDIERFQGLDCFLAGDDVKEKKPDPSIYITAAEKLGVSVKDCLVIEDSVIGLQAATKAGMSCVITYTSSTSDQDFNDAIAVYPDLSNVKLKDLETLLQTIVTAA

SEQ ID NO: 10236 - protein, 319 aa, Eutrema parvulum
MAVSCNHSAILLSPSTAGSSSVCSSSSSSSLIGFNRFPRLQTLRFKSRNAYQKSRVSSVSASSRSLEALIFDCDGVILESENLHRQAYNDAFSHFDVRCPSSSSESLNWSLEFYDKFQNLVGGGKPKMRWYFRENGWPTSTIFDSPPENDDDRAKLIDTLQDWKTERYKEIIKSGNVEARPGVTRLMDEARAAGKKLAVCSAATKSSVILCLENLIEIERFQGLDCFLAGDDVKEKKPDPSIYITAAEKLGISVKDCLVIEDSVIGLQAATKAGMSCVITYTSSTSDQDFKDAIAVYPDLGNVRLIDLETLLQTIVTAA

SEQ ID NO: 10237 - protein, 316 aa, Eutrema halophilum
MAVSCNHYSIILSSSTAGSSSRCCSSSSSSFLGFPRLQTLRLKSRSVYPRSRVSHVSASSRSLEALIFDCDGVILESENLHRQAYNDAFSHFDVRCPSSSLESLNWSLEFYDKFQNLVGGGKPKMRWYFRENGWPTSTLFDSPPENDDDRAKLIDTLQDWKTERYKEIIKSGSVEARPGVVRLMDEARAAGKKLAVCSAATKSSVILCLENLIEIERFQGLDCFLAGDDVKEKKPDPSIYITAAEKLGVSVKDCLVIEDSVIGLQAATKAGMSCVITYTSSTSDQDFKDAIAVYPDLSNVRLKDLETLLQTIVTAT

SEQ ID NO: 10238 - protein, 253 aa, Secale cereale
MRPVFVGNLDYDTRHSELDRLFYRYGRIQRIDMKSGFAFVYFEDERDGDDAIRALDGYPFGPGRRRLSVEWSRGDRGTRRDDRDGYSKPPVNTKPTKTLFVINFDPINTRVSDLERHFGHFGRISNVRIRKNFAFVQFETQEEATKALDATHLTKLLDRVISVEYAFRDDSEPGDKYDRPSRGGGYGRQDDSSYRRSVSPMYRRSRPSPDYGRPVSPQYGAYGRSRSPVRDRYRSRSPVQRSRSPAPNRRGYD

SEQ ID NO: 10239 - protein, 138 aa, Secale cereale
MRPVFVGNLDYDTRHSDLDRLFYRYGRIQRIDMKSGFAFVYFEDERDGDDAIRALDGYPFGPGRRRLSVEWSRGDRGTRRDDRDGYSKPPVNTKPTKTLFVINFDPINTRVSDLERHFGLFWEDFKCSDKEELCFRAI

SEQ ID NO: 10240 - protein, 253 aa, Triticum aestivum
MRPVFVGNLDYDTRHSELDRLFYRYGRIERIDMKSGFAFVYFEDERDGDDAIRALDGYPFGPGRRRLSVEWSRGDRGTRRDDRDGYSKPPVNTKPTKTLFVINFDPINTRVSDLERHFGHFGRISNVRIRKNFAFVQFETQEEATKALDATHLTKLLDRVISVEYAFRDDSEPGDKYDRPSRGGGYGRQDDSSYRRSVSPMYRRSRPSPDYGRPASPQYGAYGRSRSPVRDRYRSRSPVQRSRSPAPNRRGYD

SEQ ID NO: 10241 - protein, 94 aa, Pseudoroegneria spicata
MRPVFVGNLDYDTRHSELDRLFYRYGRIERIDMKSGTTEGLLLSTLRMSVMVMMQYGLWMVIPLAPGDADFQWSGHGATVEPDVMTVMAIVNHQ

SEQ ID NO: 10242 - protein, 253 aa, Leymus cinereus x Leymus triticoides
MRPVFVGNLDYDTRHSELDRLFYRYGRIERIDMKSGFAFVYFEDERDGDDAIRALDGYPFGPGRRRLSVEWSRGDRGTRRDDRDGYSKPPVNTKSTKTLFVINFDPINTRVSDLERHFGPFGRISNVRIRKNFAFVQFETQDEATKALDATHLTKLLDRVISVEYAFRDDSEPGDKYDRPSRGGGYGRQDDSSYPRSLSPVYRRSRPSPDYGRPVSPQYGAYDRSRSPVRDRYRSRSPVHRSRSPAPNRRAYD

SEQ ID NO: 10243 - protein, 253 aa, Avena sativa
MRPVFVGNLDYDTRHSELDRLFYRYGRIDRIDMKSGFAFVYFEDERDGDDAIRALDGYPFGPGRRRLSVEWSRGDRGTRRDDHDGYSKPPVNTKPTKTLFVINFDPINTRVTDLERHFGPFGKISNVRIRKNFAFVQFETQEEATKALDATHLTKLLDRVISVEYAFRDDSEPGDRYDKPGRGGGYGRQDDSSYRRSVSPVYRRSRPSPDYGRPVSPAYGSYDRSRSPVRDRYRSRSPVQRSRSPVTNRRAYD

SEQ ID NO: 10244 - protein, 261 aa, Brachypodium distachyon
MRPVFVGNLDYDTRHSELDRLFYRYGRIERIDMKSGFAFVYFEDERDGDDAIRALDGVPFGPGRRKLSVEWSRGDRGTRRDDRDGYSKPPVNTKPTKTLFVINFDPINTRVSDIERHFDPFGKISNVRIRKNFAFVQFETQEEATKALDATHSTKLLDRVISVEYAFRDDSEPGDRYDRPIRGGGGGGGYGRQDDSSYRRSVSPVYRRSRPSPDYGRPRSPAELSPVYGSYDRSRSPVRDRYRGRSPLRSRSPLANRRAYD

SEQ ID NO: 10245 - protein, 73 aa, Secale cereale
MESTSKLNSSVDTIRSVQGLLLSTLRMSVMVMMPYGLWMVIPLALGDADFQWSGHGATVEPDVMTVMATVNHQ

SEQ ID NO: 10246 - protein, 935 aa, Triticum aestivum
MLQSKSFVKKTKQGRVVKVVREHYLRDDIPCGAFSCSSCDAAARRLNADAAAILVVDTNVVLHQIDLLENPAIEDVVVLSVVLDEVKNKNLSVYNRLKTLCTNTARRFFVFTNEHHRDTYVKEMVGESPNDRNDRAIRVAARWYQSHLGDSAKVLLVTNDRDNKRKATEEGLNAETVESYVRSLAQPGLLDLVVVPSSGDVAMEDVEDLRPSKRKIVYNEHKPMSEITSGLRCGIYHQGKLRVNRYNPFEAYVGSESIGDEIIIRGSSNMNRSFDGDIVAVELLPQDQWHDSKSFIADDDEDDNEDDVRLVPNSADDAPRNTNSTQSTVGSSAASVPSRPVGRVVGIIKRNWNSYCGSLEPMPMPAGSGGVAHALFVSKDRRIPKIRIQTRQLGNLLNKRIIVAVDSWDVMSRYPSGHYVRTIGDIGDKETETEVVLIENDINTRPFSTQVLACLPPLPWTLSPEDVANPNRQDLRHVRVFSVDPPGCRDIDDALHCTPLPNGNFEVGVHIADVTNFVHPGTPLDEEASQRATSVYLVGQRIDMLPKPLTEDVCSLRADVERLAFSVIWEMTPDADIISSRYTKSVIKSCAAMSYVEAQARMDDSRLADPLTVDLRNLNSLAKIMRNRRCERGALTLASAEVKFEIDSETHDPLDIGIYQIREANQMIEEFMLAANVSVAEKILQHYPLCSLLRRHPSPTKEMLEPLLRTASSVGLNLDVSSSKALAESLDNAKRDDPYFNKLIRILATRCMTQAVYFCSGDLSLSEYYHYGLASALYTHFTSPIRRYADVVVHRLLAAALDIAKLPPVFQDGPQLTGIADNLNYRHRNAQMASRASVELHTLIYFRTRPVDTEARIVKIKANGFIVFVPKFGIEGPIYLTAKGDKGADWVVDEVHQKVTKPGTNISYAVLQSVMIHMEVVEPQPHRPKLQLTLI

SEQ ID NO: 10247 - protein, 935 aa, Triticum aestivum
MLQSKSFVKKTKQGRVVKVVREHYLRDDIPCGAFSCPSCDAAARRLNADAAAILVVDTNVVLHQIDLLENPAIEDVVVLSVVLDEVKNKNLSVYNRLKTLCTNTARRFFVFTNEHHRDTYVKEMVGESPNDRNDRAIRVAARWYQSHLGDSAKVLLVTNDRDNKRKATEEGLNAETVESYVRSLAQPGLLDLVVVPSSGDVAMEDVEDLRPSKRKIVYNEHKPMSEITSGLRCGIYHQGKLRVNRYNPFEAYVGSESIGDEIIIRGSSNMNRSFDGDIVAVELLPQDQWHDSKSFIADDDEDDNEDDVRLVPNSADDAPRNTNSTQSTVGSSAASVPSRPVGRVVGIIKRNWNSYCGSLEPMPMPAGSGGVAHALFVSKDRRIPKIRIQTRQLGNLLNKRIIVAVDSWDVMSRYPSGHYVRTIGDIGDKETETEVVLIENDINTRPFSTQVLACLPPLPWTLSPEDVANPNRQDLRHVRVFSVDPPGCRDIDDALHCTPLPNGNFEVGVHIADVTNFVHPGTPLDEEASQRATSVYLVGQRIDMLPKPLTEDVCSLRADVERLAFSVIWEMTPDADIISSRYTKSVIKSCAAMSYVEAQARMDDSRLADPLTVDLRNLNSLAKIMRNRRCERGALTLASAEVKFEIDSETHDPLDIGIYQIREANQMIEEFMLAANVSVAEKILQHYPLCSLLRRHPSPTKEMLEPLLRTASSVGLNLDVSSSKALAESLDNAKRDDPYFNKLIRILATRCMTQAVYFCSGDLSLSEYYHYGLASALYTHFTSPIRRYADVVVHRLLAAALDIAKLPPVFQDGPQLTGIADNLNYRHRNAQMASRASVELHTLIYFKTRPVDTEARIVKIKANGFIVFVPKFGIEGPIYLTAKGDKGADWVVDEVHQKVTKPGTNISYAVLQSVMIHMEVVEPQPHRPKLQLTLI

SEQ ID NO: 10248 - protein, 935 aa, Brachypodium distachyon
MLQSKSFVKKTKQGRVVKVVREHYLRDDIPCGAASCSSCDTAARRLGVDAAAILVVDTNVVLHQIDLLENPAIEDVVVLSVVLDEVKNKNLSVYNRIKTLCTNTARRFFVFTNEHHRDTYVKEMVGESPNDRNDRAIRVAARWYQSHLGESAKVMLITNDRDNKRKATEEGLNAETVESYVRSLAQPGLLDLVVVPSSGDVTMEDVEDLRPSKRKVIYSEHKPMSEITSGLRCGIFHQGKLRVNRYNPFEAYVGSESIGDEIIIRGRSNMNRAFDGDIVAVELLPQDQWNESKSFIADDDEDDNEEDVHLVPNSADDAPRNTNSTQSTVESSAASVSSRPVGRIVGIIKRNWNSYCGSLEPMPMPAGSGGVAHALFVSKDRRIPKIRIQTRQLGNLLNKRIVVAVDSWDVLSRYPSGHYVRTIGDIGDKETETEVVLIENDINTRPFSTQVLACLPPLPWSLSPDDLANPNRQDLRHVRVFSVDPPGCRDIDDALHCTPLPNGNFEVGVHIADVTNFVLPGTPLDEEASQRATSVYLVGQRIDMLPKPLTEDVCSLRADVERLAFSVIWEMTPDADIISSRYTKSVIKSCAAMSYVEAQARMDDSRLVDPLTVDLRNLNSLAKIMRNRRCERGALTLASAEVKFEIDSETHDPLDIGIYQIREANQMIEEFMLAANVSVAEKILKHYPLCSLLRRHPSPTKEMLEPLLRTASSVGLNLDVSSSKALADSLDNAKRDDPYFNKLIRILATRCMTQAVYFCSGDLSLSEYYHYGLASALYTHFTSPIRRYADVVVHRLLAAALDIAKLPPVFQDGPQLTGIADNLNYRHRNAQMASRASVELHTLIYFRTRPVDTEARIVKIKANGFIVFVPKFGIEGPIYLTAKGDKGADWVVDEVHQKVTKPGANISYAVLQSVMIHMEVVEPQPHRPKLQLTLL

SEQ ID NO: 10249 - protein, 934 aa, Sorghum bicolor
MLQSKSFVKKTKQGRIQKVVREHYLRDDVYCGFVPCSACAAAAERKLAAAAAAILVVDTNVVLHQIDLLENPAIEDVVLLSVVLDEVKNKNLSVFNRIKALCTNKARRFYVFANEQHRDTYVKDMVGESSNDRNDRAIRVAARWYQSHLGESVKVLLITNDRDNKRKAIEEGLNAETVESYVRSLAQPGLLDLVVVPSSGDVTMEDVEDHRPSKKKVIYNEHKPMSEITSGLRCGIYHQGKLRVNRYNPFEAYVGSESIGDEIVIRGRSNMNRAFDGDIVAVELLPQDQWHESKSFIADDDEEEEDVHLVPNSADDAPRNTNSTQSTVGSSAPSVSSRPVGRVVGIIKRNWNSYCGSLEPMPMPAGSGGVAHALFVSKDRRVPKIRIQTRQLENLVNKRIVVAVDSWDVLSRYPSGHYVRTIGDIGDKETETEVVLIENDINTRPFSTQVLACLPPLPWTLSPEDLANPNRQDLRQVRVFSVDPPGCRDIDDALHCTLLPNGNFEVGVHIADVTNFVHPGTPLDEEAAQRGTSVYLVGQRIDMLPKPLTEDVCSLRADVERLAFSVIWEMTPDADVISTRYTKSVIKSCAAMSYVEAQARMDDSRLVDPLTVDLRNLNSLAKIMRQRRCERGALTLASAEVKFEIDSETHDPLDIGIYQIREANQMIEEFMLAANVSVAEKILKHFPLCSLLRRHPSPTKEMLEPLLRTASSVGLNLDVSSSKALAESLDNAKSNDPYFNKLIRILATRCMTQAVYFCSGDLTFSEYYHYGLAASLYTHFTSPIRRYADVVVHRLLAAALGIAKLPPIFQDGPQLTGIADNLNYRHRNAQMASRASVELHTHIYFKTRPTDTEARIVKIKANGFIVFVPKFGIEGPIYLTPKGDKGGDWVVDEVHQRVTKPGTNISYAVLQSVRIHMEVVEPQPHRPKLQLTLI

SEQ ID NO: 10250 - protein, 934 aa, Oryza sativa
MLQSKTFVKKTRAGRVQKVVREHYLRDDISCGAASCSTCGAVEHPLSADAAAILVVDTNVVLHQIDLLENPAIDDVVLLSVVLDEVKNKNLAVFNRIKALCSNKARRFFVFTNEHHRDTYVKEMVGESPNDRNDRAIRVATRWYQSHLGENVKVLLITNDRDNKRKAIEEGINAETVESYVRSLAQPGLLDLVVVSTSGDVTMEDVEDLRPSKKKVIYSEHKPMSEITAGLRCGIYHQGKLRVNRYNPFEAYVGSESIGDEIVIHGRSNMNRAFDGDIVAVELLPQDQWHESKSFIADDDEDDEEDVHLAPNSADDAPRKANPTQSTAASSADSVSSRPVGRVVGIIKRNWNSYCGSLEPMPMPAGSGGVAHALFVSKDRRIPKIRIQTRQLGNLLDKRIIVAVDSWDVLSRYPSGHYVRTIGDIGDKDTETEVVLIENDINTRPFSTQVLACLPPLPWTLSPEDLANPNRQDLRHVRVFSVDPPGCRDIDDALHCTPLPNGNFEVGVHIADVTNFVHPGTPLDEEASQRGTSVYLVGQRIDMLPKPLTEDVCSLRADVERLAFSVIWEMTPHADIISTRYTKSVIKSCAAMSYVEAQARMDDSRLVDPLTVDLRNLNSLAKIMRHRRCERGALTLASAEVKFEIDSETHDPLDIGIYQIREANQMIEEFMLAANISVAEKILKHFPLCSLLRRHPSPTKEMLEPLLRTASSVGLNLDVSSSKALAESLDNAKNDDPYFNKLIRILATRCMTQAVYFCSGDLTFSEYYHYGLAASLYTHFTSPIRRYADVIVHRLLAAALEIAKLPPLFQDGPQLTGVADNLNYRHRNAQMASRASVELHTLIYFRTRRMDTEARIVKIKANGFIVFVPKFGIEGPIYLTPKGDKGGDWVVDEVHQRVTKPGTNVSYAVLQTVMIHMEVVEPQPHRPKLQLTLI

SEQ ID NO: 10251 - protein, 937 aa, Setaria italica
MLQSKSFVKKTKQGRIQKVVREHYLRDDIYCGFVPCSACDAAAERKLVADAAAILVVDTNVVLHQIDLLENPAIEDVVLLSVVLDEVKNKNLAVFNRIKALCTNKARRFYVFANEQHRDTYVKDMVGESSNDRNDRAIRVAAHWYQSHLGESVKVLLITNDRDNKRKAIEEGLNAETVESYVRSLAQPGLLDLVVVPTSGDVTMEDVEDHRPSKRKVIYSEHKPMSEITSGLRCGIYHQGKLRVNRYNPFEAYVGSESIGDEIVIRGRSNMNRAFDGDIVAVELLPQDQWHESKSFIADDDEEEEEEEDVHLVPNSADDAPRNASSTQSSVGSSAPSVSSRPVGRVVGIIKRNWNSYCGSLQPMPMPAGSGGVAHALFVSKDRRIPKIRIQTRQLENLVNKRIVVAVDSWGVLSRYPSGHYVRTIGDIGDKETETEVVLIENDINTRPFSTQVLACLPPLPWTLSQEDLANPNRQDLRHVRVFSVDPPGCRDIDDALHCTLLPNGNFEVGVHIADVTNFVHPGTPLDEEAAQRGTSVYLVGQRIDMLPKPLTEDVCSLRADVERLAFSVIWEMTPDADIISTRYTKSVIKSCAAMSYVEAQARMDDSRLVDPLTVDLRNLNSLAKIMRQRRCDRGALTLASAEVKFEIDSETHDPLDIGIYQIREANQMIEEFMLAANISVAEKILKHFPLCSLLRRHPSPTKEMLEPLLRTASSIGLNLDVSSSKALAESLDNAKSNDPYFNKLIRILATRCMTQAVYFCSGDLTFSEYYHYGLAASLYTHFTSPIRRYADVVVHRLLAAALEIAKLPPIFQDGPQLTGIADNLNYRHRNAQMASRASVELHTLIYFRTRPTDTEARIVKVKANGFIVFVPKFGIEGPIHLTPKGDKGGDWVVDEVHQRVTKPGTNISYAVLQTVRIHMEVVEPQPHRPKLQLTLI

SEQ ID NO: 10252 - protein, 935 aa, Zea mays
MLQSKSFVKKTKQGRIQKVVREHYLRDDIYCGFVPCTACAAAAERKLGAAAAAILVVDTNVVLHQIDLLENPAIEDVVLLSVVLDEVKNKNLSVFNRIKALCINKARRFYVFANEQHRDTYVKDMVGESSNDRNDRAIRVAARWYQSHLGESVKVLLITNDRDNKRKAIEEGLNAETVESYVRSLAQPGLLDLVVVPTSGDVSMEDVDDHRPSKKKVIYNEHKPMSEITSGLRCGIYHQGKLRVNRYNPFEAYVGSESIGDEIVIRGRSNMNRAFDGDIVAVELLPQDQWHESKSFIADDDEEEEEDVHLVPNSADDAPRNTNSTQSTVGSSAPSISSRPVGRVMGIIKRNWNSYCGSLQPMPMPAGSGGVAHALFVSKDRRVPKIRIQTRQLENLVNKRIVVAVDSWDVLSRYPSGHYVRTIGDIGDKETETEVVLIENDINTRPFSTQVLACLPPLPWTLSPEDLANPNRQDLRQVRVFSVDPPGCRDIDDALHCTLLPNGNFEVGVHIADVTNFVHPGTPLDEEAAQRGTSVYLVGQRIDMLPKPLTEDVCSLRADVERLAFSVIWEMTPDADVISTRYTKSVIKSCAAMSYVEAQARMDDSRLVDPLTVDLRNLNSLAKIMRQRRCERGALTLASAEVKFEIDSETHDPLDIGIYQIREANQMIEEFMLAANVSVAEKILKHFPLCSLLRRHPSPTKEMLEPLLRTASSIGLNLDVSSSKALAESLDNAKSNDPYFNKLIRILATRCMTQAVYFCSGDLTFSEYYHYGLAASLYTHFTSPIRRYADVVVHRLLAAALNIAKLPPIFQDGPQLTGIADNLNYRHRNAQMASRASVELHTHIYFKTRPTDTEARIVKIKANGFIVFVPKFGIEGPIYLTPKGDKGGDWVVDEVHQRVTKPGTNISYAILQTVRIHMEVVEPQPHRPKLQLTLI

SEQ ID NO: 10253 - protein, 934 aa, Elaeis guineensis
MLQSKSFVKKTKQGRVVKVVREHYLRDDIYCGALSCKVCNTSAARLSSSACTILIVDTNVVLNQIDLLENPAIEDVVVLSVVLEEVRNKNLAVYNRVKALCTNSLRKFFVFSNEHHRDTYVKEMVGESPNDRNDRAIRVAARWYQSHLGGSIQVLLITNDKENKRKAIEEGLSAETVESYVKSLGQPNLLDLVALPTSEDVGMAEVEDLRPSKRKVIYSEHKPMSEITSGLHRGIYHQGKLRVNRYNPFEAYVGSESIGDEMVVHGRANMNRAFDGDIVAVEVLPQDQWHEEKSSIIADDEDDEEEDVHLVPSSADDAPRNTNLVQPAAASAASTSSRPAGRVVGIIKRNWHSYCGSLEPMPMPAGNGGIAHALFVSKDRRIPKIRIQTRQLGNLLDKRIVVAVDSWDCLSRYPSGHYVRTIGEIGDRDTESEVLLIENDINSRPFSAQVLACLPPLPWTLSSEDLANPKRQDLRHVRVFSVDPPGCKDIDDALHCTSLPNGNFEVGVHIADVTNFVLPGTPLDDEAAQRGTSVYLVERRIDMLPKPLTEDICSLRSDVERLAFSVIWEMTPEAEIISTRYTKSVIKSCAALSYVEAQARMDDSRLMDPLTTDLRNLNSLAKVMRHQRIERGALTLASAEVKFQIDTETHDPLDIGMYQIREANQMIEEFMLAANVSVAEKILKHFPLCSLLRRHPIPTKEMLEPLLRTAAAVGLDLDVSSSKALADSLDHAVGDDPYFNKLIRILATRCMTQAVYFCSGDLSPSEYHHYGLAAALYTHFTSPIRRYADVIVHRLLAAALGIAKLPPIFMDGPQLTSIADNLNYRHRNAQMASRASVELHTLIYFRKRPTDTEARIVKIKSNGFIVFIPKFGIEGPVYLMPRGEKGGDWVVDEVHQRVTRTGTNISYGILNTVRIHMEVVEPQPSRPKLELTLI

SEQ ID NO: 10254 - protein, 779 aa, Hordeum vulgare
MLQSKSFVKKTKQGRVVKVVREHYLRDDIPCGAFSCPSCDAAARRLNADAAAILVVDTNVVLHQIDLLENPAIEDVVVLSVVLDEVKNKNLSVYNRLKTLCTNTARRFFVFTNEHHRDTYVKEMVGESPNDRNDRAIRVAARWYQSHLGDSAKVLLVTNDRDNKRKATEEGLNAETVESYVRSLAQPGLLDLVVVPSSGDVAMEDVEDLRPSKRKIVYNEHKPMSEITSGLRCGIYHQGKLRVNRYNPFEAYVGSESIGDEIIIRGRSNMNRSFDGDIVAVELLPQDQWHDSKSFIADDDEDDNEEDVRLVPNSADDAPRNTTSTQSTAGSSAASVPSRPVGRVVGIIKRNWNSYCGSLEPMPMPAGSGGVAHALFVSKDRRIPKIRIQTRQLGNLLNKRIIVAVDSWDVMSRYPSGHYVRTIGDIGDKETETEVVLIENDINTRPFSTQVLACLPPLPWTLSPEDVANPNRQDLRHVRVFSVDPPGCRDIDDALHCTPLPNGNFEVGVHIADVTNFVHPGTPLDEEASQRATSVYLVGQRIDMLPKPLTEDVCSLRADVERLAFSVIWEMTPDADIISSRYTKSVIKSCAAMSYVEAQARMDDSRLVDPLTVDLRNLNSLAKIMRNRRCERGALTLASAEVKFEIDSETHDPLDIGIYQIREANQMIEEFMLAANVSVAEKILQHYPLCSLLRRHPSPTKEMLEPLLRTASSVGLSLDVSSSKALAESLDNAKRDDPYFNKLIRILATRCMTQAVYFCSGDLSLSEYYHYGLASALYT

SEQ ID NO: 10255 - protein, 919 aa, Musa acuminata
MLQSKSFVKKTRQGRVVKVVREHYLRDDIYCGAPSCMTCNTSAARLSTSASTILIVDTNVVLNQIDLLENPAVDDVVVLSVVLEEVRNKNLAVYNRLKALCTNSLRKYFVFSNEHHKDTYVKEMVGESPNDRNDRAIRVAARWYQSHLGVNTQVLLITNDRENKRRAIEEGISAETVESYVRSLGKPDLLDLVVLSSSADVSMEDVEDLRPSKKKVIYSEHKPMSEITSGLLHGVYHQGKLRVNRYNPFEAYVGSESIGDEIVIYGRSNMNRAFDGDIVAVELLPQDQWRDGKSMIIADDEDDEEEDVHLVPSSADDAPRNENLVQPSTGSVPPVSGRPAGRVVGIIKRNWHSYCGSLEPMPMPAGNAGVAHALFVSKDRRIPKIRIQTRQLGNLLDKRIIVAVDTWDCLSRYPSGHYVLLIENDINTRPFSSQVLACLPPLPWSLSSEDLAKANREDLRHLRVFSVDPPGCKDIDDALHCMPLANGNFEVGVHIADVTNFVLAGTPLDEEASQRGTSVYLVERRIDMLPKPLTEDICSLRSDVERLAFSVIWEMTPDTEIISTRYTKSAIKSCAALSYVEAQARMDDSRMMDPLTTDLRNLNSLAKIMRLRRIERGALTLASPEVKFQIDTETHDPLDIGMYQIREANQMIEEFMLAANVSVAEKILRHFPLCSLLRRHPSPTKEMLEPLLRTAAAVGLDLDVSSSKALADSLDRAVGDDPYFNKLIRILATRCMTQAVYFASGDLSPSEFSHYGLAARLYTHFTSPIRRYADVIVHRLLAAALGIAKLPPIFLDGPQLTGIADNLNNRHRNAQMASRASVELHTLIYFKKRPTDTQGRIVKIKSNGFIVFVPKFGIEGPVYLVPKGDKRADWVVDEAHQRVTKAGSNITYGILQTVRIHMEVVEPQPNRPKLELTLI

SEQ ID NO: 10256 - protein, 939 aa, Aquilegia formosa
MLQSKSFVRKTKQGKVLKVVREHYLRDDIYCGASICKVCDTKVARLSSSASTILVLDTNVVLNQIDLLENPAIDDVVVLSVVLDEVKNKNLSVYNRLRALCSNTLRKFFVFSNEHHKDTYVKAMVGESPNDRNDRAIRVATNWYQRHLGGGTRVLLITNDKENKRKATDEGIFAETVETYVKSLGQPNLLDLVVHPTSEDVGMEDVEDLRPSKRKVIYIEHKPMSEITAGLHRGIYHQGKLRVNRYNPFEAYVGSESIGDEIIIQGRGNMNRAFDGDVVAVELLPKEQWHEGKSLSIADDDFSFIEDEEEEDVHLVPNSADDAPRNRDTIQDSSSTVNPVSCRPSGRVVGIIKRNWQSYCGSLEPMPMPAGNGGIAHALFVSKDRRIPKIRIQTRQLGNLLDKRIIVTVDSWDCLSRYPSGHYVRTIGEIGDRDTETKAILIENDINSRPFSTQVLACLPPLPWSVSTEDLMNPNRQDLRQLRVFSVDPPGCRDIDDALHCTALPDGNFEVGVHIADVTNFVHSGTPLDDEASQRGTSVYLVERRIDMLPKPLTEDICSLRSDVERLAFSVIWVMTPEAEIISTRYTKSVIKSSAVMSYVEAQARMDDSRLMDPLTTDLRNLNTLAKIMRQRRIDRGALTLASAEVKFQIDTETHDPLDIGMYQIREANQMIEEFMLAANVSVAEKILKHFSMCSLLRRHPSPTKEMLEPLLRTAAAIGLDLDVSSSKALADSLDRAVGDDPYFNKLIRILATRCMPQAVYFCSGDLTPPEFHHYGLASPLYTHFTSPIRRYADVIVHRLLAAALGIYKLPTIFQDRPQLTSIADNLNYRHRNAQMASWASVELHTLIFFRKRPTDTEARIVKIRANGFIVFVPKYGIEGPVYLTPKGEKGGDWVVDEEHQKVKKMDGSISYSVLQMVQIHMEVVEPQPNRPKLQLTLM

SEQ ID NO: 10257 - protein, 936 aa, Phalaenopsis aphrodite
MLQSKSFVKKTKQGRVIKVVREHYLRDDIYCGAVICKVCDASSARLSSAASTILIIDTNVVLHQIDLLENPAIKNVIVLSVVLEEVRNKNAAVYNRIKTLCTDAMKNFFVFSNEHHRDTYVKEMVGESPNDRNDRAIRVAAHWYQSHLGGSTQILLITNDRENKKKAIEEGLFAETVESYVRSLQQPNLLDLVVIPAALDIVKEEVDDLRPSKRKVFYLEHKPMSEITSGLLHRIYHQGKLRVNRYNPFEAYVGSESVGDEIVIYGRVNMNRAFDGDIVAVELLPQDQWTEEKSLLAVDDDEDEEDDIHLVPSSFDDAPRNANLAKVSAGSAPTVTSRPIGRVVGIIKRNWSSYCGSLEPMPLPAGNGGVAHALFISKDRRIPKIRIQTRQLGNLLDKRIIVAVDSWDCSSRYPFGHYVRTIGQIGDRETESEVVLIENDINSRPFSVQVLACLPPLPWSLSSEDLAKPYRKDLRHLRVFSVDPPGCKDIDDALHCTPFADGNFEVGVHIADVTNFVHPGTPLDEEAAQRGTSVYLVEKRIDMLPKPLTEDICSLRSDVERVAFSVIWEMTPDAEIISTRYTKSIIKSCAALSYVEAQARMDDSRMIDPLTTDLRNLNSLAKIMRQRRIERGALTLASAEVKFQIDTETHDPLDIGMYQIREANQMIEEFMLAANVSVAEKILRHFPLCSLLRRHPTPTKEMLEPLLRTAAAVGLHLDISSSKALADSLDHAVGDDPYFNKLIRILTTRCMTQAVYFCSGDLTSADFHHYGLAAPLYTHFTSPIRRYADVIVHRLLAAALGIAKLPPIFLDGPQLTEIADNLNYRHRNAQMASRASVELHTLIYFRNRPTDTEARIVKIKANGFIVFVPKFGIEGPVHLTSKGDKGGEWIVDEAHQTVTKTSTNMSYRPLQTVRIHLEVVEPQAHRPKLELSLIGM

SEQ ID NO: 10258 - protein, 937 aa, Vitis vinifera
MLQSKSFVRKTKQGKVVKVVREHYLRDDIYCGASICKVCDSSTARLSPSASTILILDTNVVLNQIDLLENPAIDDVVVLSVVLEEVKNKNISVYNRLRTLCSNSMRKFFVFSNEYHKDTYVKQMAGESPNDRNDRAIRVATQWYQSHLGAAARVLLITNDRENKRKATEEGISAETVESYVKALGQPGLLDLLVQPAPEDVGMEEVEDLRPSKRKVIYSEHKPMSEITSGLHRGIYHQGKLRVNRYNPFEAYVGSESIGDEIIIYGRGNMNRAFDGDVVAVELLPQDQWQEEKSLSIADEEDEEEEDVHLVPSSADDAPRNTDLAQGSVGGTKAVLCRPSGRVVGIIKRNWHSYCGSLEPMPMPAGNGGIAHALFVSKDRRIPKIRIQTRQLGNLLDKRIIVAVDSWDCLSRYPSGHYVRTIGEIGDRDTESEVVLIENDINSRPFSLQVLACLPPLPWSVSSEDLANPCRLDLRHVCVFSVDPPGCKDIDDALHCTTLPNGNFEVGVHIADVTNFVHPGTPLDDEAAQRGTSVYLVERRIDMLPKPLTEDICSLRSDVERLAFSVIWEMTPQAEIISTKYTKSIIKSCAALSYIEAQARMDDSRLMDPLTMDLRNMNALAKVMRLRRIERGALTLASAEVKFQIDTETHDPLDIGMYQIREANQMVEEFMLAANVSVAEKILKHFPLCSLLRRHPSPTREMLEPLLRTAAAVGLNLDVSSSKALADSLDHAVGDDPYFNKLIRILATRCMTQAVYFCSGDLSPPEFHHYGLAAPLYTHFTSPIRRYADVIVHRLLAASLGLYKLPTIFQDNAQLTSTADNLNYRHRNAQMAGRASVELHTLIYFRKRPTDTEARIVKIRSNGFIVFVPKYGIEGPVYLTPRGEKGGGEWVVDEQQQKVKKMDGSISYSVLQTVMIHMEVVEPQPNRPKLELALICR

SEQ ID NO: 10259 - protein, 306 aa, Triticum aestivum
MRGIASAGTLRPGPSAAVRSKSNAAGRPTLHRRPLLHLRRSPEPSLPSIRRSRRLMPPLTAAARATSSGGDAFRELASAADFAAIASPDGRISVVGFGSLLSERSARSTFPELEGFRVAALRGFRRVFAHAAPIFFERGIAIEATKEFSSLSVEHCEGEMIVVTVFEIKEEEVPAFIERELEFRFLAVVPEGLDGVPFPNPAVVCARYSDEEYFQVRCKGSKEIYNQHYGRYNIDKIWRDDILPCRLYLRHCVLAAKNLGEPAYSNFLDHTYLGDRRTTIREYLATTGAGIMEEEPPETLRSRYGG

SEQ ID NO: 10260 - protein, 339 aa, Triticum aestivum
MRQLSSLLQGLARSMALGKERKEEEQGTVLRTSGTLRGEGSGTLAAVWSRRGEKGTNQDCSVVWEGFGCQEDTIFCGIFDGHGQWGHYVSKAVRDSLPPSLLRRWQEAVTLASLINGEKKLCDSQFDLWKQSYLAAAAAVDEELRRSRRLDAVNSGSTALSIVKKGDTMVIANVGDSRAVLGTTSDDGSIAAVQLTVDFKPNLPQEKARIVQCKGRVHCHEDEPGVHRVWLPDREAPGLAMSRAFGDYCVKDYGVISAPEVTQRRITARDQFVILATDGVWDVVSNEEAVQIVAATPEREKAAKRLVQWAVRAWRRKRRGYAVDDCSAICLFFHHSPPS

SEQ ID NO: 10261 - protein, 415 aa, Secale cereale
PTHSPSGRSVPHVLRLCTPPTVSSVTQKLREQGSRERKKLFAPPNSFGLAIEIAAAVVAAARGSARSMDGKREEGGGAARGRCCGRRGRSGARALRRLAAVWSRRGEKGTNQDCSVVWEGFGCQDDTIFCGIFDGHGQWGHYVSKAVRDSLPPSLLCRWREAVTLASLIDGEKRLCDSQFDLWKQSYLAAAAAVDEELRRSRRLDAVNSGSTALSVVKKGDTMMIANVGDSRAVLGTTSDDGSIAAVQLTVDFKPNLPQEKARIVQCKGRVHCHDDEPGVHRVWLPGREAPGLAMSRAFGDYCVKDYGVISAPEVTQRRITSRDQFVILATDGVWDVVSNEEAVQIVAATPDREKAAKRLVQCAVRAWRRKRRATPSTTARRSASSSTRRHRRRTASSQHCREDQGRERRPSFSW

SEQ ID NO: 10262 - protein, 309 aa, Brachypodium distachyon
MRGVASPVTLRPRASPVVRSKSNAPGTSTFHRQSLVPPRLHLRLSPAPVPSQPPISRSHRLMPPTAAATTSEAGSFTELTSAADFATIASADGRISVIGFGSLLSERSARSTFPELEGFRVAALRGFRRVFAHAAPIFFDRGIAIEATKEFSSLSVEQCEGEMIVVTVFEIKEEEVPAFIERENEFRFLVVVPEGLDQVPFPNPAVVCARYSDEEYFQVRCKGSKEIYNQHYGRYNIDKIWRDDILPCRLYLRHCVLAAKNLGEAAYSSFLDHTYLGDRKTTIREYLATTGAGIMEEEPPESLKSRYGG

SEQ ID NO: 10263 - protein, 278 aa, Secale cereale
GRPTLHRRPLLHLRRSPEPSLPSIRRLMPPLTVAALATSSAGDAFSELASAADFSAIASPEGRISVIGFGSLLSERSARSTFPELEGFRVAALRGFRRVFAHSAPIFFERGIAIEATKEFSSLSVEYCEGEMIIVTVFEIKEEEVPAFIERELEFRFLAVVPEGLDGAPFPHPAVVCARYSDEEYFQVRCKGSKEIYNQHYGRYNIDKIWRDDILPCRLYLRHCVLAAKNLGEPAYSNFLDHTYLGDRRTTIREYLATTGAGIMEEEPPETLRTRYGG

SEQ ID NO: 10264 - protein, 523 aa, Zea mays
MAWARLASRSRLRPAASAAGRSRHASTPAPPPPPSPPTTRTVPAATSAPPLRRLLLLPRHRFADATPSASTAWLLGARWRQGHGRRCFASAAYPAQATPGEASELVDVPLAQTGEGIAECELLRWFVAEGDQVDEFQPLCEVQSDKATIEITSRFKGKVHKIHFVPGDIVKVGETLLKMVVGDSQIVSPDNIVPSAGKSLGVESAVFSSEGNVPGGNLSTPAVRHLAKQYGISINEIVGTGKDGRVLKEDVLNYAVSKGVCKQQSLASEGNIGQVELLEEGKALLDEDFYEDKKILLRGYQRSMVKSMSLAAKVPHFHYLEEINCDSLVQLKTTFQNENKDQTIKHTFLPFLIKSLSMALSKYPMLNSSFIEETNEVVFKGPHNIGVAMATTHGLVVPNIKKVQSLSILEITKELARLHEMASQNRLSAADIEGGTITLSNIGAIGGKFGSPLLNLPEVAIIALGRIQKLPRFDDDENVYPSSIINVTVGADHRVVDGATVARFCNEWKSLVEKPELLLLHMR

SEQ ID NO: 10265 - protein, 471 aa, Panicum virgatum
MAPLPRAARLLRSAVGLLRSPPPPPARLFSSAAGTGTGTGTGAGTGREAAIVATAVALAGSGLGLWLKPPSLADSGEAVGGQISVAGGGGAAEAREEKGRFLFADSFRRRVFFNYEKRIRLLSPPEKIFEYFASVRNPEGEVYMLPSDLMRALVPVFPPSESTAVREGRLRGERSPGELHCAPSEFFMLFDTNSDGLISFAEYIFFVTLLSIPESNFSAAFKMFDVDHSGLIDKEEFKKIMALMRSFNRQGATHKDGLRIGLKVGQPVENGGVVEFFFGNDGNEPLHYDKFTKFLKDLHDEIIRLEFSHYDVKSSKTIPAKDFALSMVASADMNHISMLLDRVDDLVNKPDLKDIRISFEEFKAFAYLRRRLEPLSMAIFAYGKVNGLLTKQDLKRAAQHVCGVDLTDRMVDIIFHVFDTNQDGNLSLEEFLRALQRRETDIRQPTIPGPLGFLSCWFGGRKCSSLRQMLF

SEQ ID NO: 10266 - protein, 464 aa, Zea mays
MAPLSRAARLLRCAVGRLRLPPPARAFSSAAAATETGAGNGREAVIAAAAVAMAGSGLGLWLKPPSLADSGEAPGGQISVTCAASTEAQEEKGRFLFADSFRRRVFFNYEKRIRLLSPPEKIFEYFASVRNPEGEVYMLPGDLMRAVVPVFPPSESTIVREGRLRGERSPGELHCAPSEFFMLLDTNSDGLISFAEYIFFVTLLSIPESHFTAAFKMFDVDHSGVIDREEFKKVMSLMRSFNRQGSTHKDGLRIGLKVGQPVENGGVVEYFFGSDGNEPLHCVRFSNFLKELHDEIIRLEFSHYDVKSSKTIPAKDFALSMVASADMNHINKLLDRADGLVKEPDLKDIRITFEEFKAFADLRQRLEPLSMAIFAHGKVNGLLTKEDLKRATQHVCGVNLTDRVVDIIFHVFDTNQDGNLSSEEFLRALERRETAIRQPTIPGPWGFLSCWFSGRKCSLKQVVL

SEQ ID NO: 10267 - protein, 250 aa, Zea mays
MAPLRRASRLLRSAVCRLRSPAPARAFSSAAATETGAVIAAAAVAVASSGLGLWLKPPSLADSGEAPGDQISVACAGATEAREEKGWFLFADSFRRRVFFNYEKRIRLLSPPEKIFEYFASVRNREGEVYMLPADLMRAVVPVFPPSESTVVREGRLRGERSPGELHCAPSEFFMQFDTNNDGLISFAEYIFFVTLLSIHESNFTVAFKMFDIDHINLSRQEKRPARYEHVQSSDLFVDGKRRGDRQRRV

SEQ ID NO: 10268 - protein, 326 aa, Panicum virgatum
MEVAPAAAKQKTKKHIHLFYCSECEELALKIAASSDAIELQSINWRSFDDGFPNLFINKAHDIRGQHVAFLASFSSPAVIFEQISVIFALPKLFIASFTLVLPFFPTGSFERVEEEGDVATAFTLARILSMVPKSRGGPTSVVIYDIHALQERFYFGDDVLPCFETGIPLLLQRLRQLPDADNITIAFPDDGAWKRFHKLLQHFPMIVCNKVREGDKRIVRIKEGNPEGRHVVIVDDLVQSGGTLRECQKVLASHGAAKVSAYVTHAVFPKQSYERFMTSNSAGPGDQFAYFWITDSCPHTVKAIGQRPPFEVLSLAGSIADALQI

SEQ ID NO: 10269 - protein, 328 aa, Saccharum officinarum
MEVVGAAKQKAKKHEKHIHLFYCSECEELALKVAASSDAIELQSINWRSFDDGFPNLFINKAHDIRGQHVAFLASFSSPAVIFEQISVIFALPKLFIASFTLVLPFFPTGSFERVEEEGDVATAFTLARILSMIPKSRGGPTSVVIYDIHALQERFYFGDDVLPCFETGIPLLLQRLRQLPDAENITIAFPDDGAWKRFHKLLQHFPMIVCNKVREGDKRIVRIKEGNPEGRHVVIVDDLVQSGGTLRECQKVLASHGAAKVSAYVTHAVFPERSYERFMSSNSAGPGDQFAYFWITDSCPHTVKAIGQRPPFEVLSLAGSIADALQI

SEQ ID NO: 10270 - protein, 325 aa, Zea mays
MEVVAAAKQKAKKHIHLFYCSECEELALKVAASSDVIELQSINWRSFDDGFPNLFINKAHDIRGQHVAFLASFSSPAVIFEQVSVIFALPKLFIASFTLVLPFFPTGSFERVEEEGDVATAFTLAHILSMIPKSRGGPTSVVIYDIHALQERFYFGDDVLPCFETGIPLLLQRLRQLPDAENITIAFPDDGAWKRFHKLLQHFPMIVCNKVREGDKRIVRIKEGNPEGRHVVIVDDLVQSGGTLRECQKVLASHGASKVSAYVTHAVFPKQSYENFMASNSAGPGDQLAYFWITDSCPHTIKAIGQRPPFEVLSLAGSIADALQI

SEQ ID NO: 10271 - protein, 328 aa, Setaria italica
MEVATAAAAAKQKPKKHIHLFYCSECEELALKIAASSDAIELQSINWRSFDDGFPNLFINKAHDIRGQHVAFLASFSSPAVIFEQISVIFALPKLFIASFTLVLPFFPTGSFERVEEEGDVATAFTLARILSMIPKSRGGPTSVVIYDIHALQERFYFGDDVLPCFETGIPLLLQRLRQLPDADNITIAFPDDGAWKRFHKMLQHFPMIVCNKVREGDKRIVRIKEGNPEGRHVVIVDDLVQSGGTLRECQKALASHGAAKVSAYVTHAVFPKQSYERFMTSNSAGPGDQFAYFWITDSCPHTVKAIGQRPPFEVLSLAGSIADALQI

SEQ ID NO: 10272 - protein, 328 aa, Pennisetum glaucum
MEVTPTAAAAKQKPKKHIHLFYCSECEELALKIAASSDAIELQSINWRSFDDGFPNLFINKAHDIRGQHVAFLASFSSPAVIFEQISVIFALPKLFIASFTLVLPFFPTGSFERVEEEGDVATAFTLARILSMIPKSRGGPTSVVIYDIHALQERFYFGDDVLPCFETGIPLLLQRLRQLPDADNITIAFPDDGAWKRFHKMLQHFPMIVCNKVREGDKRIVRIKEGNPEGRHVVIVDDLVQSGGTLRECQKVLASHGAAKVSAYVTHAVFPKQSYERFMTSNSAGPGDQFAYFWITDSCPQTVKAIGQSSPFEVLSLAGSIADALQI

SEQ ID NO: 10273 - protein, 332 aa, Sorghum bicolor
MEVVAAAAAAAKQKTKKHEKHIHLFYCSECEELALKVAASSDAIELQSINWRSFDDGFPNLFINKAHDIRGQHVAFLASFSSPAVIFEQISVIFALPKLFISSFTLVLPFFPTGSFERVEEEGDVATAFTLARILSMIPKSRGGPTSVVIYDIHALQERFYFGDDVLPCFETGIPLLLQRLRQLPDAKNITIAFPDDGAWKRFHKLLQHFPMIVCNKVREGDKRIVRIKEGNPEGRHVVIVDDLVQSGGTLRECQKVLASQGAAKVSAYVTHAVFPKRSYERFMASNSVGPGDQFAYFWITDSCPHTVKAIGQRPPFEVLSLAGSIADALQI

SEQ ID NO: 10274 - protein, 326 aa, Brachypodium distachyon
MEVAAPAPKHKVKKQINLFYCAECEELALKVAASSDAIQLQSINWRNFPDGFPNLFINNAHDIRGQHVAFLASFSSPAVIFEQISVIFALPKLFIASFTLVLPFFPTGSFERVEEEGDVATAFTLARVLSMIPKSRGGPTSVVIYDIHALQERFYFGDDVLPCFETGIPLLLQRLRQLPDAENITIAFPDDGAWKRFHKLLVNFPMVVCAKVREGDKRIVRIKEGNPEGRHVVIVDDLVQSGGTLRECQKVLAAHGAAKVSAYVTHAVFPNQSYERFMTANSAGPGDQFAYFWITDSCPQTVKAISRHSPFEVLSLAGSIADALQI

SEQ ID NO: 10275 - protein, 302 aa, Cenchrus ciliaris
  misc_feature (146)..(146): Xaa can be any naturally occurring amino acid
EELALKIAASSDAIELQSINWRNFDDGFPNLFINKAHDIRGQHVAFLASFSSPAVIFEQISVIFALPKLFIASFTLVLPFFPTGSFERVEEEGDVATAFTLARILSMIPKSRGGPTSVVIYDIHALQERFYFGDDVLPCFETGIPXLLQRLRQLPDADNITIAFPDDGAWKRFHKMLQHFPMIVCNKVREGDKRIVRIKEGNPEGRHVVIVDDLVQSGGTLRECQKVLASHGAAKVSAYVTHAVFPKQSYERFMTSNSAGPGDQFAYFWITDSCPQTVKAIGQSSPFEVLSLAGSIADALQI

SEQ ID NO: 10276 - protein, 328 aa, Leymus cinereus x Leymus triticoides
  misc_feature (81)..(81): Xaa can be any naturally occurring amino acid
  misc_feature (111)..(111): Xaa can be any naturally occurring amino acid
  misc_feature (130)..(130): Xaa can be any naturally occurring amino acid
  misc_feature (186)..(186): Xaa can be any naturally occurring amino acid
MEVAAAAAVPRHKVKKQINLFYCAECEELALKVAAASDAIQLQSINWRNFPDGFPNLFINNAHDIRGQHVAFLASFSSPAXIFEQISVIFALPKLFIASFTLVLPFFPTGXFERVEEEGDVATAFTLARXLSMIPKSRGGPTSVVIYDIHALQERFYFGDDVLPCFETGIPLLLQRLSQLPDADNXTIAFPDDGAWKRFHKSLANFPVVVCAKVREGDKRIVRIKEGNPEGRHVVIVDDLVQSGGTLRECQKVLASQGAAKVSAYVTHAVFPNQSYERFMTANSAGPGDQFAYFWITDSCPQTVKAISQKPPFEVLSLATSIADALQI

SEQ ID NO: 10277 - protein, 328 aa, Hordeum vulgare
MEVAAAVAVPRHKVKKQINLFYCAECEELALKVAAASDAIQLQSINWRNFPDGFPNLFINNAHDIRGQHVAFLASFSSPAIIFEQISVIFALPKLFIASFTLVLPFFPTGTFERVEEEGDVATAFTLARILSMIPKSRGGPTSVVIYDIHALQERFYFGDDVLPCFETGIPLLLQRLSQLPDADNVTIAFPDDGAWKRFHKSLANFPVVVCAKVREGDKRIVRIKEGNPEGRHVVIVDDLVQSGGTLRECQKVLAAHGATKVSAYVTHAVFPNQSYERFMTANSAEPGDQFAYFWITDSCPQTVKAISQQPPFEVLSLASSIADALQI

SEQ ID NO: 10278 - protein, 331 aa, Triticum aestivum
MEVAAAAAAVAVPRHKVKKQINLFYCAECEELALKVAAASDAIQLQSINWRNFPDGFPNLFINNAHDIRGQHVAFLASFSSPAIIFEQISVIFALPKLFIASFTLVLPFFPTGTFERVEEEGDVATAFTLARILSMIPKSRGGPTSVVIYDIHALQERFYFGDDVLPCFETGIPLLLQRLSQLPDADNVTIAFPDDGAWKRFHKSLANFPVVVCAKVREGDKRIVRIKEGNPEGRHVVIVDDLVQSGGTLRECQKVLAAHGATKVSAYVTHAVFPNQSYERFMTANSAGPGDQFAYFWITDSCPQTVKAISQQPPFEVLSLASSIADALQI

SEQ ID NO: 10279 - protein, 328 aa, Hordeum vulgare
MEAAAAVAVPRHKVKKQINLFYCAECEELALKVAAASDAIQLQSINWRNFPDGFPNLFINNAHDIRGQHVAFLASFSSPAIIFEQISVIFALPKLFIASFTLVLPFFPTGTFERVEEEGDVATAFTLARILSMIPKSRGGPTSVVIYDIHALQERFYFGDDVLPCFETGIPLLLQRLSQLPDADNVTIAFPDDGAWKRFHKSLANFPVVVCAKVREGDKRIVRIKEGNPEGRHVVIVDDLVQSGGTLRECQKVLAAHGATKVSAYVTHAVFPNQSYERFMTANSAEPGDQFAYFWITDSCPQTVKAISQQPPFEVLSLASSIADALQI

SEQ ID NO: 10280 - protein, 331 aa, Secale cereale
MEVAAAAAAVAVPRHKVKKQINLFYCAECEELALKVAAASDAIQLQSINWRNFPDGFPNLFINNAHDIRGQHVAFLASFSSPAIIFEQISVIFALPKLFIASFTLVLPFFPTGTFERVEEEGDVATAFTLARILSMIPKSRGGPTSVVIYDIHALQERFYFGDDVLPCFETGIPLLLHRLSLLPDADNVTIAFPDDGAWKRFHKSLANFPVVVCAKVREGDKRIVRIKEGNPEGRHVVIVDDLVQSGGTLRECQKVLAAHGATKVSAYVTHAVFPNQSYERFMTANSAGPGDQFAYFWITDSCPQTVKAISQQPPFEVLSLASSIADALQI

SEQ ID NO: 10281 - protein, 281 aa, Panicum virgatum
RSFDDGFPNLFINKAHDIRGQHVAFLASFSSPAVIFEQISVIFALPKLFIASFTLVLPFFPTGSFERVEEEGDVATAFTLARILSMVPKSRGGPTSVVIYDIHALQERFYFGDDVLPCFETGIPLLLQRLRQLPDADNITIAFPDDGAWKRFHKLLQHFPMIVCNKVREGDKRIVRIKEGNPEGRHVVIVDDLVQSGGTLRECQKVLASHGAAKVSAYVTHAVFPKQSYERFMTSNSAGPGDQFAYFWITDSCPHTVKAIGQRPPFEVLSLAGSIADALQI

SEQ ID NO: 10282 - protein, 316 aa, Zingiber officinale
  misc_feature (177)..(177): Xaa can be any naturally occurring amino acid
  misc_feature (243)..(243): Xaa can be any naturally occurring amino acid
MAKRANKQVNLFYCAECEELARKVADHSDAIQLRTISWRNFDDGFPNLFINNAHDIRGQHVAFLASFSSPGVIFEQISAIFALPKLFIASFTLVLPFFPTGSFERVEEEGDVATAFTMARILSMIPKSRGGPTSVVIYDIHALQERFYFGDDVLPCFETGIPLLLQRLHKLPDAENXTIAFPDDGAWKRFHKLLLHFPMVVCAKVREGDKRIVRIKEGNPEGRHVVIVDDLVQSGGTLIECQXVLAAHGAGKVSAYVTHGVFPNKSWERFLHKGSEYQFAHFWITDSCPVTVKAITDKPPFEVLSLAGSIADALQI

SEQ ID NO: 10283 - protein, 319 aa, Musa acuminata
MAKRAKKQINLFYCAESEELARKVADHSDVIQLQTITWRNFDDGFPNLFINNAHDIRGQHVAFLASFSSPGVIFEQISAIFALPKLFISSFTLVLPFFPTGSFERMEEEGDVATAFTMARILSMIPKSRGGPTSIVIYDIHALQERFYFGDDVLPCFETGIPLLLQRLHELPDADNITIAFPDDGAWKRFHKLLMHFPMVVCAKVREGDKRIVRIKEGNPEGRHVVIVDDLVQSGGTLIECQKVLAAHGAGKVSAYVTHGVFPKRSWERFLHNNAEGSDHQFAYFWITDSCPLTVKAIANKAPFEVLSLAGSIATALQI

SEQ ID NO: 10284 - protein, 271 aa, Panicum virgatum
VHQQGARHPGQHVAFLASFSSPAVIFEQISVIFALPKLFIASFTLVLPFFPTGSFERVEEEGDVATAFTLARILSMVPKSRGGPTSVVIYDIHALQERFYFGDDVLPCFETGIPLLLQRLRQLPDAENITIAFPDDGAWKRFHKLLQHFPMIVCNKVREGDKRIVRIKEGNPEGRHVVIVDDLVQSGGTLRECQKVLASHGATKVSAYVTHAVFPKQSYERFMTSNSAGPGDQFAYFWITDSCPHTVKAIGQRPPFEVLSLAGSIADALQI

SEQ ID NO: 10285 - protein, 119 aa, Musa acuminata
MHDFCFTIPYGLLVLVGGVVGYARRGSTASLAGGAGSGVVLLLAGFLSLKAFEKRRNSYLALALETLCSLILTFVMGKRYLETSKIMPAGLVAALSAMMSLFYLYKIASGGNHIPTKAE

SEQ ID NO: 10286 - protein, 174 aa, Sorghum bicolor
MSSSTSFGALLLHGRLHSPSLPSKAQLFLALPNNPTRFRTSASVRVDAYPPRWPLRAADGERDNRVQELRVPDSWLTPAGAAQESEWLRETLHKWLDDEYCPEPANVDISSTAAGSYHESLIAGQSDLGEILLKMVGDLDKLSYRESFHGPFSAANAAVRLISQRMESLSLPDE

SEQ ID NO: 10287 - protein, 170 aa, Saccharum officinarum
MSSSTSAALLLHGRLHSPSPPSKPQLFLALPNNPTRFPASASVRVAYPPRWPLRAAGGEQDNRVQELRVPDSWLTPGGAAQESEWLRETLHKWLDDEYCPEPANVDISSTAAASYRESLIAGQSDLGEILLKLVGDLDKLSYRESFHGPFSAANAAGRLIIQRMESLADE

SEQ ID NO: 10288 - protein, 407 aa, Sorghum bicolor
MAAPAQAQVLPLLRWSRSASFLCASPRRLFSALRRPAAAARCEAGSKAMLKGMDYSELENWVQAQGFRPGQAMMLWKCLYGNNVWAHCYDELTGLNKDFRKMITEHADLKALTVKDIHTASDGTRKILFSLEDGSVIETVIIPCARGRTTVCVSSQVGCAMNCQFCFTGRMGLRKHLSTAEIVEQAVFARRLFSDEFGSINNVVFMGMGEPFHNIDNVIKASAIMVDGQGLQFSPRKVTVSTSGLVPQLKRFLQESNCSLAVSLNATTDEVRNWIMPINRKYNLNLLLGTLREELNLRKKQIVLFEYVMLSGVNDSMDDAKRLIELVQGIPCKINLISFNPHGGSQFKPTPDDKIIEFRNVLIQGGLTVFVRLSRGDDQMAACGQLGEPGDYQLPLLRVPEKFQVAL

SEQ ID NO: 10289 - protein, 410 aa, Setaria italica
MAAQALPFLRWSRSASSLRAHCSATAAPRRLFSALRRPAAAAARCEAGSKVMLKGMDYSELENWVQAQGFRPGQAMMLWKCLYGNNVWAHCHDELTGLNKDFRKMITERADLKALTVKDILTASDGTRKILFSLEDGPVIETVIIPCARGRTTVCVSSQVGCAMNCQFCFTGRMGLRKHLSTAEIVEQAVFARRLFSDEFGAITNVVFMGMGEPFHNIDNVLKASAIMVDDQGLHFSPRKVTVSTSGLVPQLKRFLHESNCSLAVSLNATTDEVRNWIMPINRKYNLNLLLGTLREEVCLRKNYRVLFEYVMLSGVNDSMDDAKRLIELVQGIPCKINLISFNPHSGSQFKPTPDEKILEFRNVLIQGGLIVFVRLSRGDDQMAACGQLGEPGDYQLPLLRVPEKFQVAV

SEQ ID NO: 10290 - protein, 405 aa, Oryza sativa
MAALPLLRWGASSLRGGHSSAPPSSRLFSALRRPPAAARCEPGSRVMLKGMDYPELENWVRSQGFRPGQAMMLWKCLYGNNVWAHCYDELAGLNKDFRKMLTDHADLKALTVKDILNASDGTRKILFSLEDGSVIETVVIPCTSGRTTVCVSSQVGCAMNCQFCFTGRMGLRKHLSTAEIVEQAVFARRLFSDEFGSITNVVFMGMGEPLHNIDNVLKASAIMVDEQGLQFSPRKVTVSTSGLVPQIKRFLQESNCALAVSLNATTDEVRNWIMPINRKYNLSLLLGTLREEIRLKKKYKVFFEYVMLAGVNDSVDDAKRLVDLVRGIPCKINLISFNPHSGSQFKPTPDEKIIEFRNILIQDGLVVFVRLSRGDDQMAACGQLGEPGDYQLPLLRVPEKFQVAL

SEQ ID NO: 10291 - protein, 247 aa, Sorghum bicolor
MPLVGCPRRGPPLSPACRHRRSLYRARAVAPKCEASSSSPPPLLTRRLSAASLLLAVLPVPASSPQLPVASASQAEAKEAEGESGASEGIELERYTDQEQGFTLLKPTSWPKVEKAGATALFQQEGKGSNNIGVVVNPVRLNSLTEFGTPQFVADRLLQAEKKKESTKTAEVISVGERSGHGGLTVYEIEYTLDSTRGGMKRIFSGAFVASRKLYLLNIACSDTQEKPLDSETRIVLEKVLHSFDSV

SEQ ID NO: 10292 - protein, 267 aa, Sorghum bicolor
MEVTSSSSSPSAPPPGSSKPALRLNPAAVLLRRLPTPTPTTATPVTASEPPARPGGASNPLAAFLSSLIPFWRERRWGPPKQPAHPAASSAAARRAAEQEAEAEARQLVGCAVPLFRPYVAQLPWHGGYAGVAVEAVPALRPLLRTQLSSGNGSVLWDRRPVDHLDFCCYCHDMAYDTHDQAQLLRADLAFLRCLEGSRRTPARDGIAAAVIYRAMCIFGLKTILIPYRTNLVRLQTGPNYADFFADFVKRVASSSGRPTGGEKQRL

SEQ ID NO: 10293 - protein, 402 aa, Panicum virgatum
MAAAPPHVRAAPLARALCARASATAAAAVPPKPQSQANSCRALLGLSETDLRQLALDLGQQSYRGKQLHDLLYKSRAKQIQEFNHVPKAFREALLGAGWTVGRSPVHHAVTASDGTAKILLKLEDNRLIETVGIPVNDDNKGSSRLTACVSSQVGCPLRCSFCATGKGGFARNLRPHEIVEQVLAIEEMFKHRVTNVVFMGMGEPMLNLKSVLEAHRCFNKELKIGQRMMTISTVGVPNTIKMLASHKLQSTLAVSLHAPNQKLRETIVPSAKSYPLGALMDDCKSYFLETGRRVSFEYTLLAGTNDEREHAEELAELLRTCGGGYHVNLIPYNPIEGSEYKRPYRKVVQAFVDALEARKITVSVRQTRGLDANAACGQLRNEFQKNPLLESSTSEPNLAPL

SEQ ID NO: 10294 - protein, 388 aa, Triticum aestivum
MAAPQQVRAVRLARALRLRTRASAAAAPETSRRALLGLTEPELRQLAVDLGQQSYRGKQLHDLVYKNRAKQVEEFAYVPKVFREALVGAGWNVGRSPVHHAVTATDGTTKILLKLEDNRLVETVGIPVDDRGTPRLTTCVSSQVGCPLRCSFCATGKGGFARNLKGHEIVEQVLAIEESFKHRVTNVVFMGMGEPMLNLKAVLEAHQCLNKELKIGQRMMTISTVGVPNTISKLASHKLQSTLAVSLHAPNQRLRETNVPSAKAYPLEALMDDCKNYFLENGRRVSFEYTLLAGINDEKAHAEELAALLHACGGGYHVNLIPYNPVEGSEYKRPYRKAIQAFVDALESRKITVSVRQTRGLDANAACGQLRNEFQKNPLLESSPPSEP

SEQ ID NO: 10295 - protein, 379 aa, Pennisetum glaucum
SASAAPPRSQSQGGTSRRALLGLSEPELRQLALDLGQQSYRGKQLHDLLYKSRASQIQDFNYVPKAFREALLGAGWTVGRSPVHHAVTASDGTTKILLKLEDNRLIETVGIPVDDDSKGSSRLTACVSSQVGCPLRCSFCATGKGGFARNLRPHEIVEQVLAIEEMFKHRVTNVVFMGMGEPMLNLKSVLEAHRCFNKELKIGQRMMTISTVGVPNTIKMLASHKLQSTLAVSLHAPNQKLRETIVPSAKSYPLGALMDDCKSYFLETGRRVSFEYTLLAGINDEKEHAEELAELLRTCGGGYHVNLIPYNPIEGSEYKRPYRKVVQAFVDALEARKITVSVRQTRGLDANAACGQLRNEFQKNPLLESSPSEPSLIPA

SEQ ID NO: 10296 - protein, 409 aa, Brachypodium distachyon
MAAPQQVRAVPLARALRLSTRVSASAPARSASTPPRRALLGLSEPELRQLAVDLGQQSYRGKQLHDLVYKNRATQIEAFAYVPKVFREALVGAGWRVGRSPVHHAVTATDGTTKILLKLEDNRLVETVGIPVDDKGSSRLTACVSSQVGCPLRCSFCATGKGGFARNLHGHEIVEQVLAIEESFKHRVTNVVFMGMGEPMLNLKAVLEAHRCLNKELKIGQRMMTISTVGVPNTINKLATHKLQSTLAVSLHAPNQKLRETIVPSAKAYPLEALMDDCKNYFLETGRRVSFEYTLLAGINDEKAHAEELAALLHACGGGYHVNLIPYNPVEGSEYKRPYRKAIQAFVDALESRKITVSVRQTRGLDANAACGQLRNEFQKNPLLESSPPSETNQPLESSPPSEPSLVTA

SEQ ID NO: 10297 - protein, 399 aa, Sorghum bicolor
MAAPQHVRAAPLARALRASATATATATVSASAPAPAPIKSQGTSRRALLGLSEPQLRQLALDLGEESYRGKQLHDLLYKSRAKQIQDFNHVPKAFREALLGAGWSAGRSPVHHAVTASDGTTKILLKLEDNRLIETVGIPVDDDNKGSSRLTACVSSQVGCPLRCSFCATGKGGFARNLQPNEIVEQVLAIEETFKQRVTNVVFMGMGEPMMNLKSVLEAHRCFNKELKIGQRMMTISTVGVPNTIKMLASHKLQSTLAVSLHAPNQKLRETIVPSAKSYPLGALMDDCKNYFLETGRRVSFEYTLLAGINDEKEHAEELAELLRTCGGGYHVNLIPYNPIEGSEYKRPYRKVVQAFVDALEARKITVSVRQTRGLDANAACGQLRNEFQKNPLLAIEA

SEQ ID NO: 10298 - protein, 405 aa, Triticum aestivum
MAAPQQVRAVPLARALRLRTRASAAAPPETSRRALLGLTEPELRQLAVDLGQQSYRGKQLHDLVYKNRAKQVEEFAYVPKVFREALVGAGWNVGRSPVHHAVTATDGTTKILLKLEDNRLVETVGIPVDDRGTPRLTACVSSQVGCPLRCSFCATGKGGFARNLKGHEIVEQVLAIEESFKHRVTNVVFMGMGEPMLNLKAVLEAHQCLNKELKIGQRMMTISTVGVPNTISKLASHKLQSTLAVSLHAPNQRLRETIVPSAKAYPLEALMDDCKNYFLETGRRVSFEYTLLAGINDEKAHAEELAALLHACGGGYHVNLIPYNPVEGSEYKRPYRKAIQAFVDALESRKITVSVRQTRGLDANAACGQLRNEFQKNPLLESSPPSEPNQLLESSTPSEPSLVPA

SEQ ID NO: 10299 - protein, 405 aa, Hordeum vulgare
MAAPQQVRAVPLARALRLRTRASAAAPPETSRRALLGLTEPELRQLAVDLGQQSYRGKQLHDLVYKNRAKQVEEFAYVPKVFREALVGAGWNVGRSPVHHAVTATDGTTKILLKLEDNRLVETVGIPVDDRGTPRLTACVSSQVGCPLRCSFCATGKGGFARNLKGHEIVEQVLAIEESFKHRVTNVVFMGMGEPMLNLKAVLEAHQCLNKELKIGQRMMTISTVGVPNTISKLASHKLQSTLAVSLHAPNQRLRETIVPSAKAYPLEALMDDCKNYFLETGRRVSFEYTLLAGINDEKAHAEELAALLHACGGGYHVNLIPYNPVEGSEYKRPYRKAIQAFVDALESRKITVSVRQTRGLDANAACGQLRNEFQKNPLLESSTPSEPNQLLESSSPSEPSLVPA

SEQ ID NO: 10300 - protein, 405 aa, Secale cereale
MAAPQQVRAVPLARALRLRTRASAAAPPETSRRALLGLTEPELRQLAVDLGQQSYRGKQLHDLVYKNRAKQVEEFAYVPKVFREALVGAGWNVGRSPVHHAVTATDGTTKILLKLEDNRLVETVGIPVDDRGTPRLTACVSSQVGCPLRCSFCATGKGGFARNLKGHEIVEQVLAIEESFKHRVTNVVFMGMGEPMLNLKAVLEAHQCLNKELKIGQRMMTISTVGVPNTISKLASHKLQSTLAVSLHAPNQRLRETIVPSAKAYPLEALMDDCKNYFLETGRRVSFEYTLLAGINDERAHAEELAALLHACGGGYHVNLIPYNPVEGSEYKRPYRKAIQAFVDALESRKITVSVRQTRGLDANAACGQLRNEFQKNPLLESSPPSEPNQLLESSTPSEPSLVPA

SEQ ID NO: 10301 - protein, 419 aa, Secale cereale
MAAPQQVRAVPLARALRLRTRASAAPAAAPETSRRALLGLTEPELRQLAVDLGQQSYRGKQLHDLVYKNRAKQVEEFAYVPKVFREALVGAGWNVGRSPVHHAVTATDGTTKILLKLEDNRLVETVGIPVDDRGTPRLTACVSSQVGCPLRCSFCATGKGGFARNLKGHEIVEQVLAIEESFKHRVTNVVFMGMGEPMLNLKAVLEAHQCLNKELKIGQRMMTISTVGVPNTISKLASHKLQSTLAVSLHAPNQRLRETIVPSAKAYPLEALMDDCKNYFLETGRRVSFEYTLLAGINDEKAHAEELAALLHACGGGYHVNLIPYNPVEGSEYKRPYRKAIQAFVDALESRKITVSVRQTRGLDANAACGQLRNEFQKNPLLESSPPSEPNQLLESSPPSEPNQLPEASTPSEPSLVPA

SEQ ID NO: 10302 - protein, 263 aa, Vigna unguiculata
MAPKKGVKAAVAAPKKKLGTIKEKVTNPLFEKRPKQFGIGGALPPKRDLTRFVKWPKTVQIQRKKRILKQRLKVPPALNQFTKTLDKNLATNLFKMLLKYRPEDKAEKKERLLKRAQAEADGKSVEAKKPIVVKYGLNHVTYLIEQNKAQLVVIAHDVDPIELVVWLPALCRKMEIPYCIVKGKARLGTVVHKKTASVLCLTTVKNEDKLEFSRILEAIKANFNDKYDEYRKKWGGGIMGSKSQAKTRAKEKLIAKEAAQRMS

SEQ ID NO: 10303 - protein, 251 aa, Flaveria ramosissima
VKAVATKKKTEKVVNPLFEKRPKQFGIGGALPPKKDLHRFVRWPQVVRIQRKRRILKQRLKVPPALNQFTKTLDKNLATTLFKMLLKYRPEDKAAKKERLLKRAQAESEGKTVEAKKPIVVKYGLNHVTYLIEQNKAQLVIIAHDVDPIELVVWLPALCRKMEIPYCIVKGKSRLGAIVHQKTAAALCLTTVKNEDKMEFSRILEAIKANFNDKYDEYRKKWGGGIMGSKSQAKTKAKERVLAKEAAQRMN

SEQ ID NO: 10304 - protein, 259 aa, Unknown
  Sequence found in Organisms: Solanum lycopersicum, Solanum tuberosum
MAPKKGVAVAAKKKAEKTSKVVNPLFEKRPKQFGIGGALPPKKDVTRNVRWPRNVTLQRKKRILKMRLKVPPALNQFTKTLDKNLATNLFKMLLKYRPEDKAAKKERLVKRAQAEAEGKTPETKKPIIVKYGLKHITYLIEQNKAQLVVIAHDVDPIELVVWLPALCRKMEIPYCIVKGKARLGSIVHKKTASALCLTTVKNEDKMEFSRVLEAIKANFNDKYEENRKKWGGGIMGSKSQARTKAKERVLAKEAAQRLN

SEQ ID NO: 10305 - protein, 256 aa, Capsicum annuum
MAPKKGVVAIKKTEKLKVVNPLFEKRSKQFGIGGALRPKKDLSRFVPWPQGVQIQRKKRILKQRLKVPPALNQFSKTLDKNIATNLFKMLLKYRPEDKATKKERLVKRAQTEAEGKTPETKKPIVVKYGLKHITYLIEQNKAQLVVIAHDVDPIELVVWLPALCRKMEIPYCIVKGKARLGSIVHKKTASALCLTTVKNEDKMEFSRVLEAIKANFNDKYEENRKKWGGGIMGAKSQARTKAKERVLAKEAAQRLN

SEQ ID NO: 10306 - protein, 263 aa, Marchantia polymorpha
MAPKRGTIKTPVPAPVEKKKVVEKVANPLFEKRPKQFGIGGALPPKRDLHRFVKWPKYVRIQRQRRVLNQRLKVPPALNQFTKTLDKNLAASLFKMLLKYRPEDKAAKKERLLKKAQAEAEGKTVETKKPIVVKYGINHVTYLIEQGKAQLVVIAHDVDPIELVVWLPALCRKMGVPYAIVKGKSRLGQIIHSKTATALCLTSVKNEDKHDFSKIVEAVKANFNDRYDEYRKQWGGGIMGVKSQAKTKIKEKIIAKEAAQRAA

SEQ ID NO: 10307 - protein, 534 aa, Zea mays
MAAKQAVVAAAASGHPKMGEEKLIIRPEKVRFIDVLSMLLLRRPITSYAFVEAGDRTAADLGSTPGDWLVALTQVIQKALAGAYYPALVVGAVVEFLLNFVALNNGILGIFLNLFRCKLVIPLNREAPNFRSMIGMIDGRTELKPLPASGGPEDRRLQVVGVSAAAGSGGDDYYLDVESGSAAVPLVQQQYVNGRLVRLRTFSVFEVSMMAAKIAYENAAYIENVVNNVWKFHFVGFYNCWNKFVGDHTTQAFVFTDKAEDASVVVVSFRGTEPFNMRDWSTDVNLSWLGMGELGHVHVGFLKALGLQEEDGKDATRAFPKAAPNAVPGKPLAYYALREEVQKQLQKHPNANVVVTGHSLGAALAAIFPALLAFHGERGVLDRLLSVVTYGQPRVGDKVFAGYVRANVPVEPLRVVYRYDVVPRVPFDAPPVADFAHGGTCVYFDGWYKGREIAKGGDAPNKNYFDPRYLLSMYGNAWGDLFKGAFLWAKEGKDYREGAVSLLYRATGLLVPGIASHSPRDYVNAVRLGSVASA

SEQ ID NO: 10308 - protein, 336 aa, Zea mays
MKLIAVYFIQLLHAMIHMHGNEHAIQKLRRGDAAEADGVDVVPGAVRRDAGHEQAGGAVEQRDGALAVVLALLGPQEGALEEVPPRVAVHGQQVPGVEVVLVGRVAALGDLAALVPAVEVDAGAAVREVGDGRRVEGHARDHVVAVHHPERLHGHVGAHVAREHLVAHARLPVGDHGEQAVQDAPLPVERQQRREDGRQRGAEAVAGDHDVGVRVLLQLLLDLLAQRVVGQRLARDGVGGGLGERPRGVLAVLLLQAQRLEEADVDVAQLAHAQPRQVHVRGPVPHVEGLRAPERHHHHARVLCLVGEHERLRRVVAHELCICTSVKIIMLPSRRC

SEQ ID NO: 10309 - protein, 536 aa, Panicum virgatum
MVALKQQQPAAGGPKMGAEKLIIRTEKVRFIDILSMLFLRRPITSYPFVEAGDQTAADFGSTPGDWFVALTQLIQKALAGAYYPALMIGAVVEFLLNFIALNNGILGIFLNIFRCKLVIPLNREAPNFRSMIAMIDGRTELKPLPAGGGPDDQRLQVVGVSAGGGGKDDYYVDVESGECGSASVPLLQQQYVNGRLIRLRTFSVFEVTVMAAKIAYENAAYIENVVKNVWKFNFVGFYSCWNKFVGEHTTQAFVMTDKASDASVVVVSFRGTEPFNMRDWSTDVNLSWLGMADMGHVHVGFLKALGLQEEDGKDAARAFPKDAPNAAAGKPLAYYKLREVVRDQLAKHPGATLVVTGHSLGGALAAIFPALLALHGEQDVLDRLLAVVTYGQPRVGDKVFADFLRARLRVEMLRVVYRYDVVPRVPFDAPPVAEYAHGGTCVYFDGWYRGAAIPGGGDAPNPNYFDPRFLLSMYGNAWGDLFKGAFLWAKEGRDYREGAVSLLYRAAGLLVPGLASHSPRDYVNAVRLGSIAAKEA

SEQ ID NO: 10310 - protein, 539 aa, Setaria italica
MVAKQQQLATGGGPKMGAEKLIIRSEKVRFVDILSMLFLRRPITSYPFVEAGDQTAADVGSTPGDMFVLLTQIIQKALAAAYYPAVMIGTVVEFILNFIALNNGILGIFLNIFRCKLVIPLNREAPNFRSMIGMIDGRTELKPLPAGGGPDDRRLQVVGVSGAGKAATVGEDYYVDVESGECGGASVPLVHQQYVNGRLIRLRTFSIFEVTVMAAKIAYENAAYIENVVKNVWKFNFVGYYSCWNKFVGDHTTQAFVMTDKEADASVVVVSFRGTEPFNMRDWSTDVNLSWLGMGAMGHVHVGFLKALGLQEEDGKDAARAFPKAAPNADAGKPLAYYKLREVIQDQLKKHPKANLVVTGHSLGGALAAIFPALLAFHGERDVLDRLISVVTYGQPRVGDKVFAAFLRANVPVELLRVVYRYDVVPRVPFDAPPVAEFVHGGTCVYFNGWYKCTAIADGGDAPNPNYIDPRYLLSMYGNAWGDLVKAAFLGMKEGKDYREGAVSLLYRAAGLLVPGLASHSPRDYVNAARLGSMTAKEA

SEQ ID NO: 10311 - protein, 208 aa, Zea mays
MSSPPPPPMSTLHKCCSSPSQPSPKLPPKLQRPAESRHKPICGGARLRITRRAHAASLLLLGLAGAAVPAPVRAAEDDGSSGGEGVLGAIKSIFDPNETTKAGKVLPKAYLKAAREVVRTLRESLEEDDGGDMARFRRNADAAKESIRAFLGGWRGQQAVTDEESYVALEKAIRSLAEFYSKAGPSASLPQDVKNKILDDLSAADAYL

SEQ ID NO: 10312 - protein, 205 aa, Panicum virgatum
MLSPPPPPMPTLSKCCCSSPSPKLQRPAETGKKPTCGGAARLPITRRAHAASLLLLGLAGMAVAAPAPARADDASNGGEEEGVLGAIKSIFDPNEKTKAGKVLPKAYLKAAREVVRTLRESLEEDDGGDMARFRRNADAARESIREFLGGWRGQQAVAAEESYVALEKAIRSLAEFYSKAGPSAPLPQDVRNKILDDLSTADAYL

SEQ ID NO: 10313 - protein, 398 aa, Setaria italica
MASNGNGSLANGASTHGKPIKCKAAVAWGPGEPLAMEEVEVAPPGRREVRVKLLFTSICHTDLSFLKGENEQQRKFPRILGHEAAGVVESVGDGVEDLAPGDHVVPIFNGECGACAYCKSGKTNLCGTYRVNPFKSTMTSDGGTRFSVVDASSGERRPVYHFLNTSTFAEYTVLDAACAVKVHPKAPLEKMCLLSCGISTGVGAAWNTANVSTGSTVAVFGLGAVGLAVAEGARLRGAARIIGVDINPEKFTKGKEMGVTDFIDSKACDKPVHEVIREMTDGGVDYSFECTGINDVLREAFLSTHDGWGLTVVLGIHATPKMMPLHPMELFDGRRITGCVFGDFKGKSQLPDIVDKCMSGELKVNFDGFITHKMPFSDTNKAIQLLEEGKSLRCVLHF

SEQ ID NO: 10314 - protein, 398 aa, Zea mays
MAANGKSSLANGASTGGKPIKCKAAVAWGPGEPLVMEEVEVAPPGRLEVRVKLLFTSICHTDLSFLKGENELHRKFPRILGHEAAGVVESVGDGVEDLAAGDHVIPIFNGECGACAYCESDRTNLCGTYRVDASKSTMVSDGGTRFSVADRVSGRTVPVYHFLNTSTFTEYTVLDAACAAKVNPEAPLQKMCLLSCGISTGVGAVWNTANVSAGSTVAIFGLGAVGLAVAEGARLRGAARIIGVDINPEKFTKGREMGVTDFVDSRASDKPVHEVIREMTHGGVDYSFECTGINGVLREAFVSTHDGWGLTVVLGIHATPKMLPLHPMELFDGRRITACVFGDVKGKSQLPAIVDKCVNGDLDINLDGFITHRMPFSDINKAIQLLEEGKSLRCVLNL

SEQ ID NO: 10315 - protein, 397 aa, Panicum virgatum
MASNGNGSLANGASTRGKPIKCKAAVAWGPSEPLTMEEVEVAPPGRLEVRVKLLFTSICHTDLSFLKGENELQSKFPRILGHEAAGVVESVGEGVEDLAAGDHVVPIFNGECGACAYCESDKTNLCGTYRVNPFKSTMASDGGTRFSVVDGTGERRPVYHFLNTSTFAEYTVLDAACAVKVHPKAPLDKMCLLSCGISTGVGAAWNTANINTGSTVAVFGLGAVGLAVAEGARLRGAARIIGIDINSEKFTKGKEMGVTDFIDSKACDKPVHEVIREMTDGGVDCSFECTGINDVLREAFLSTHDGWGLTVILGIHATPKMMPLHPMELFDGRRITGCVFGDFKGKSQLPDLVDKFMNGRLNLNFDGFITHNMSFSDINKAFQLLEEGKSLRSVLHF

SEQ ID NO: 10316 - protein, 406 aa, Setaria italica
MDGTMAAAAANGNGSLANGGSGTRGKPIKCKAAVAWGPGEPLSLEEVEVAPPGRLEVRVKVLFTSICHTDLSAWKGETEMHRKFPRIFGHEAAGVVESVGDGVEDLVPGDHVIPIFTGECRECVYCGSDKTNLCGTYRVNPFKSTMTSDGGTRFAVVDASSGERQPVYHFLNTSTFAEYTVLDAACAVKVHPKAPLEKMCLLSCGISTGVGAAWNTANVSTGSTVAVFGLGAVGLAVAEGARLRGAARIIGVDINPEKFTKGKEMGVTDFIDSKACGKPVHEVIREMTDGGVDYSFECTGINDVLREAFLSTHDGWGLTVVLGIHATPKMMPLHPMELFDGRRITGCAFGDFKGKSQLPDLVDKCINGEVNINFDGFITHKLPFSDINKAFQLLEEGKSLRCLLNF

SEQ ID NO: 10317 - protein, 374 aa, Panicum virgatum
AAVAWGPSEPLTMEEVEVAPPGRLEVRVKLLFTSICHTDLSFLKGENELQSKFPRILGHEAAGVVESVGEGVEDLAAGDHVVPIFNGECGACAYCESDKTNLCGTYRVNPFKSTMASDGGTRFSVVDGTGERRPVYHFLNTSTFAEYTVLDAACAVKVHPKAPLDKMCLLSCGISTGVGAAWNTANINTGSTVAVFGLGAVGLAVAEGARLRGAARIIGIDINSEKFTKGKEMGVTDFIDSKACDKPVHEVIREMTDGGVDCSFECTGINDVLREAFLSTHDGWGLTVILGIHATPKMMPLHPMELFDGRRITGCVFGDFKGKSQLPDLVDKFMNGRLNLNFDGFITHNMCFSDINKAFQLLEEGKSLRSVLHF

SEQ ID NO: 10318 - protein, 396 aa, Brachypodium distachyon
MEAANGFSNGGSTQGKPIKCKAAVAWGPGEPLVMEEVEVAPPAPMEVRVKVLFTSICHTDLSFWKGENERQRKFPRILGHEAAGVIESVGEGVKDLAPGDHVVPIFTGECGTCAYCESSKTNLCGTYRVNPFKSTMVSDNGTRFSVVDRSSGAPQPVYHFLNTSTFAEYTVLDSACAVKINPQAPLEKMCLLSCGISTGVGAAWNTANVSKESTVAVFGLGAVGLAVAEGARIRGAARIIGVDINPDKFTKGKEMGVTDFIESKACGKPVHELIRDMTGGGVDCSFECTGIVDVLREAFLSTHDGWGLTVALGIHPTPRMLPLHPMELFDGRRITGCVFGDFKGKSQLPLLVDQCINGEVKINFDGFITHEMPFSEINEAFRLLEEGKSLRCVLRL

SEQ ID NO: 10319 - protein, 394 aa, Pseudoroegneria spicata
MATNGYSNGGSTKGKPIKCKAAVAWGPGEPLVMEEVQVAPPARMEVRVKVLFTSICHTDLSFLRGENERQRRFPRIFGHEAAGVVESVGEGVEDLAPGDHVVPIFNGECGTCAYCHSSATNLCGTYRVDAFKSTMVSDDGTRFSVVNTSGDTVPVYHFLNTSTFAEYTVLDAACAVKINPGAPLEKMCLLSCGISTGVGAAWNTANVSKGSTVAIFGLGAVGLAVGEGARIRGASRIIGVDINSEKFAKGKEMGITDFINSKACGKPVHEVIRELTDGGVDYSFECSGNVDVLREAFVSTHDGWGLTVVLGIHPTPRMMPLHPMELFDGRRITGCVFGDFKGKSQLPLLVDQYMQGEVKINFDGFITHEMPFSEINEAFRLLEEGKSLRCVLRL

SEQ ID NO: 10320 - protein, 394 aa, Hordeum vulgare
MATNGYSNGGSTKGKPIKCKAAVAWGPGEPLVMEEVEVAPPARMEVRVKVLFTSICHTDLSFWRGENERQRRFPRILGHEAAGVVESVGEGVEDLAPGDHIVPIFNGECGTCAHCHSSATNLCGTYRVNPFKSTMVSDDGTRFSVVNTSGDTVPVYHFLNTSTFAEYTVLDAACAVKINPAAPLEKMCLLSCGISTGVGAAWNTANVSKGSTVAIFGLGAVGLAVGEGARIRGASRIIGVDINPEKFAKGKEMGITDFINAKACGKPVHEVIRELTDGGVDYSFECSGNVDVLREAFVSTHDGWGLTVVLGIHPTPRMMPLHPMELFDGRRITGSVFGDFKGKSQLPLLVDQCMQGEVKINFDGFITHEMPFSEINEAFRLLEEGKSLRCVLRL

SEQ ID NO: 10321 - protein, 394 aa, Sorghum bicolor
MTNGNGGVAGGTRGKPIKCNAAVAWGPGVPLSVEEVEVAPPGPLEVRVKVLFTSICHTDLSAWKGENEMHRKYPRILGHEAAGVVESVGEGVDGLAPGDHVIPIFTGECEKCVYCKSDKTNLCGTYRVDPFKTTMVFDNGTRFSLVDRNSGLRQPVYHFLNTSTFTEYTVLDAACAVKINPKAPLHKMCLLSCGISTGVGAAWNSADVSAGSTVAVFGLGAVGLAVAEGARLRGAARIIGVDVNPAKFSKGKEMGVTDFVDSRTCDKPVHEVISEMADGGVDYSFECTGISDVLREAFLSTHDGWGLTVMLGIHSTPKMVPLHPMELYGRRIIGCVFGDFKGKSQLPNLVDKCVSGEVNINFDGFITHKMPFSDINKAFQLLEEGKSLRCLLNL

SEQ ID NO: 10322 - protein, 394 aa, Triticum aestivum
MATNGYSNGGSTKGKPIKCKAAVAWGPGEPLVMEEVGVAPPARMEVRVRILFTSICHTDLSFLRGENERQRRFPRILGHEAAGVVESVGEGVEDLAPGDHVVPIFNGECGTCAYCHSSATNLCGTYRVDAFKSTMVSDNGTRFSVVNTSGDTVPVYHFLNTSTFAEYTVLDAACAVKINPAAPLEKMCLLSCGISTGVGAAWNTANVSKGSTVAIFGLGAVGLAVGEGARIRGASRIIGVDINPEKFAKGKEMGITDFINPKACGKPVHEVIKELTDGGVDYSFECSGNVDVLREAFVSTHDGWGLTVVLGIHPTPRMMPLHPMELFDGRRITGCTFGDFKGKSQLPLLVDQCMKGEVKINFDGFITHEMPFSEINEAFRLLEEGKSLRCVLRL

SEQ ID NO: 10323 - protein, 394 aa, Triticum aestivum
MATNGYSNGGSTKGKPIKCKAAVAWGPGEPLVMQEVEVAPPARMEVRVKVLYTSICHTDLSFWRGENERQRRFPRIFGHEAAGVVESVGEGVEDLAPGDHVVPIFNGECGTCAYCHSSATNLCGTYRVDAFKSTMVSDNGTRFSVVNTSGDTVPVYHFLNTSTFAEYTVLDAACAVKINPAAPLEKMCLLSCGISTGVGAAWNTANVSKGSTVAIFGLGAVGLAVGEGARIRGASQIIGVDINPEKFAKGKEMGITDFVNSKACGKPVHEVIRELTDGGVDYSFECSGNVDVLREAFVSTHDGWGLTVVLGIHPTPRMMPLHPMELFDGRRITGCTFGDFKGKSQLPLLVDQCMQGEVKINFDGFITHEMPFSEINEAFRLLEEGKSLRCVLRL

SEQ ID NO: 10324 - protein, 394 aa, Secale cereale
MATNGYSNGGSTKGKPIKCKAAVVWGPGEPLVMEEVEVAPPARMEVRVRILFTSICHTDLSFWRGENERQRRFPRILGHEAAGVVESVGEDVEDLAPGDHVVPIFNGECGTCAYCHSSATNLCGTYRVDPFKSTMVSDDGTRFSVVNTSGDTVPVYHFLNTSTFAEYTVLDAACAVKINPAAPLEKMCLLSCGISTGVGAAWNTANVSKGSTVAIFGLGAVGLAVGEGARIRGASRIIGVDINPEKFAKGKEMGITDFINPKACGKPVHEVIKELTDGGVDYSFECSGNVDVLREAFVSTHDGWGLTVVLGIHPTPRMMPLHPMELFDGRRITGCTFGDFKGKSQLPLLVDQCMKGEVKINFDGFITHEMPFSEINEAFRLLEEGKSLRCVLRL

SEQ ID NO: 10325 - protein, 412 aa, Secale cereale
ELPLPLIEKQRKKKRSSHHGNQWVLQWRQHQRKAHQVQSGGGVGPGEPLVMEEVEVAPPARMEVRVRILFTSICHTDLSFWRGENERQRRFPRILGHEAAGVVESIGEDVEDLAPGDHVVPIFNGECGTCAYCHSSATNLCGTYRVDPFKSTMVSDDGTRFSVVNTSGDTVPVYHFLNTSTFAEYTVLDAACAVKINPAAPLEKMCLLSCGISTGVGAAWNTANVSKGSTVAIFGLGAVGLAVGEGARIRGASRIIGVDINPEKFAKGKEMGITDFINPKACGKPVHEVIKELTDGGVDYSFECSGNVDVLREAFVSTHDGWGLTVVLGIHPTPRMMPLHPMELFDGRRITGCTFGDFKGKSQLPLLVDQCMKGEVKINFDGFITHEMPFSEINEAFRLLEEGKSLRCVLRL

SEQ ID NO: 10326 - protein, 394 aa, Triticum aestivum
MATNGYSNGGSTKGKPIKCKAAVAWGPGEPLVMQEVEVAPPARMEVRVKVLYTSICHTDLSFWRGENERQRRFPRILGHEAAGVVESVGEGVEDLAPGDHVVPIFNGECGTCAYCHSSATNLCGTYRVDAFKSTMVSDDGTRFSVVNTSGDTVPVYHFLNTSTFAEYTVLDAACAVKINPAAPLQKMCLLSCGISTGVGAAWNTANVSKGSTVAIFGLGAVGLAVGEGARIRGASRIIGVDINPEKFAKGKEMGITDFISPKACGKPVHEVIKELTDGGVDYSFECSGNVDVLREAFVSTHDGWGLTVVLGIHPTPRMMPLHPMELFDGRRITGCTFGDFKGKSQLPLLVDQCMQGEVKINFDGFITHEMPFSEINEAFRLLEEGKSLRCVLRL

SEQ ID NO: 10327 - protein, 394 aa, Secale cereale
MATNGYSNGGSTKGKPIKCKAAVVWGPGEPLVMEEVEVAPPARMEVRVRILFTSICHTDLSFWRGENERQRRFPRILGHEAAGVVESVGEGVDDLAPGDHVVPIFNGECGTCAYCHSSATNLCETYRVDAFKSTMVSDDGTRFSVVNTSGDTVPVYHFLNTSTFAEYTVLDAACAVKINPAAPLEKMCLLSCGISTGVGAAWNTANVSKGSTVAIFGLGAVGLAVGEGARIRGASRIIGVDINSEKFAKGKEMGITDFINPKACGKPVHEVIKELTDGGVDYSFECSGNVDVLREAFVSTHDGWGLTVVLGIHPTPRMMPLHPMELFDGRRITGCTFGDFKGKSQLPLLVDQCMQGEVKINFDGFITHEMPFSEINEAFRLLEEGKSLRCVLRL

SEQ ID NO: 10328 - protein, 394 aa, Triticum aestivum
MATNGYSNGGSTKGKPIKCKAAVAWGPGEPLVMQEVEVAPPAHMEVRVKVLYTSICHTDLSFWRGENERQRRFPRILGHEAAGVVESVGEGVEDLAPGDHVVPIFNGECGTCAYCHSSATNLCGTYRVDAFKSTMVSDDGTRFSVVNTSGDTVPVYHFLNTSTFAEYTVLDAACAVKINPAAPLEKMCLLSCGISTGVGAAWNTANVSKGSTVAIFGLGAVGLAVGEGARIRGASRIIGVDINPEKFAKGKEMGITDFINPKACGKPVHEVIKELTDGGVDYSFECSGNVDVLREAFVSTHDGWGLTVVLGIHPTPRMMPLHPMELFDGRRITGCTFGDFKGKSQLPLLVDQCMQGEVKINFDGFITHEMPFSEINEAFRLLEEGKSLRCVLRL

SEQ ID NO: 10329 - protein, 394 aa, Triticum aestivum
MATNGYSNGGSTKGKPIKCKAAVAWGPGEPLVMQEVEVAPPARMEVRVKVLYTSICHTDLSFWRGENERQRRFPRIFGHEAAGVVESVGEGVEDLAPGDHVVPIFNGECGTCAYCHSSATNLCGTYRVDAFKSTMVSDNGTRFSVVNTSGDTVPVYHFLNTSTFAEYTVLDAACAVKINPAAPLEKMCLLSCGISTGVGAAWNTANVSKGSTVAIFGLGAVGLAVGEGARIRGASRIIGVDINPEKFAKGKEMGITDFINPKACGKPVHEVIKELTDGGVDYSFECSGNVDVLREAFVSTHDGWGLTVVLGIHPTPRMMPLHPMELFDGRRITGCTFGDFKGKSQLPLLVDQCMQGEVKINFDGFITHEMPFSEINEAFRLLEEGKSLRCVLRL

SEQ ID NO: 10330 - protein, 403 aa, Oryza sativa
MDATAIGNGALHSNGAGADTKGKPIKCKAAVAHGPGEALVMEEVEVAPPARMEVRLKVLFTSICHTDLSAWKGENELQRKFPRILGHEAAGVVESVGEGVEDLAPGDHVVPIFTGECGACTYCESSKSNLCKTYRVNPFKSTMVTDGGTRFTMIDRSSGARNPVYHFLNTSTFAEYTVIDSACAVKINPKAPLEKMSLLSCGVSTGVGAAWNTANVSKGSTVAIFGLGAIGLAVAEGARLRGASRIIGVDINPEKFSKGKEMGITDFINSKASGKPVHEVIMEMTDGGVDYSFECTGITDVLREAFVSTHDGWGLTVVLGIHATPRMLPLHPMELFDGRRITGCVFGDFKGKSQLPEIVEKCMQGEININFDGFITQELPFADINKAFQLLEEGKSLRCLLHV

SEQ ID NO: 10331 - protein, 394 aa, Leymus cinereus x Leymus triticoides
  misc_feature (12)..(12): Xaa can be any naturally occurring amino acid
  misc_feature (28)..(28): Xaa can be any naturally occurring amino acid
  misc_feature (64)..(64): Xaa can be any naturally occurring amino acid
  misc_feature (77)..(77): Xaa can be any naturally occurring amino acid
  misc_feature (139)..(139): Xaa can be any naturally occurring amino acid
  misc_feature (328)..(328): Xaa can be any naturally occurring amino acid
  misc_feature (336)..(336): Xaa can be any naturally occurring amino acid
  misc_feature (355)..(355): Xaa can be any naturally occurring amino acid
  misc_feature (393)..(393): Xaa can be any naturally occurring amino acid
MATNGYSNGGSXKGKPIKCKAAVAWGPXEPLVMEEVQVAPPERMEVRVKVLFTSICHTDLSFWXGENERQRRFPRIXGHEAAGVVESVGEGVEDLAPGDHVVPIFNGECGTCAYCHSSATNLCGTYRVDAFKSTMVSDXGTRFSVVNTSGDTVPVYHFLNTSTFAEYTVLDAACAVKINPAAPLEKMCLLSCGISTGVGAAWNTANVSKGSTVAIFGLGAVGLAVGEGARIRGASRIIGVDINPEKFAKGKEMGITDFINSKACGKPVHEVIKELTDGGVDYSFECSGNVDVLREAFVSTHDGWGLTVVLGIHPTPRMMPLHPMELFXGRRITGCXFGDFKGKSQLPLLVDQCMXGEVKINFDGFITHEMPFSEINEAFRLLEEGKSLRCVLXL

SEQ ID NO: 10332 - protein, 394 aa, Secale cereale
MATNGYSNGGSTKGKPIKCKAAVVWGPGEPLVMEEVEVAPPARMEVRVKILFTSICHTDLSFWRGENERQRRFPRILGHEAAGVVESVGEDVEDLAPGDHVVPIFNGECGTCAYCHSSATNLCGTYRVDPFKSTMVSDDETRFSVVNTSGDTVPVYHFLNTSTFAEYTVLDAACVVKINPAAPLEKMCLLSCGISTGVGAAWNTANVSKGSTVAIFGLGAVGLAVGEGARIRGASRIIGVDINPEKFAKGKEMGITDFINPKACGKPVHEVIKELTDGGVDYSFECSGNVDVLREAFVSTHDGWGLTVVLGIHPTPRMMPLHPMELFDGRRITGCTFGDFKGKSQLPLLVDQCMKGEVKINFDGFITHEMPFSEINEAFRLLEEGKSLRCVLRL

SEQ ID NO: 10333 - protein, 403 aa, Setaria italica
MAYTSSLHLPKLLLLPNPRRTRHRPSFVPAAAAKASGVNGHAPPEKPAPNGKAHINGVNGKKGVNGVNGKKGVNGHADRIHLTVSTGGGGQDGTGLRVAFQGAPGAYSEFAAKTALPGCDTVPCRAFADALAAVERGGADRAILPVESTMEGTALRNYDLLLRHDLVVAQEINLFVHYCLLAMPGVRAAEVRRVISHPMALAHCGRALARLGVDREPVEDTAGAVEMLRSNRMLDTAAIASPRAADLYGLDVLAHGLQDESWNVTRFLLLSRPPPPVALPVDADAKTSMVVAHRGGSMMVLLKVLSAFSSRNINLTKLEVINNDGAAAPAAAGAGARPPVMILDTSARGAPTLRAFPHVLYVDCAGAAHDPRVREAIQEIEKFAVFVRVLGCYAADSTVYDLQ

SEQ ID NO: 10334 - protein, 388 aa, Zea mays
MAYTSSLNLPKHLLLPSPRRTRHRPSSFVPTAAAKVNGDAPERPAPNGKARINGQGKKGVNGHADRIHLSVSTGGGGQDGSGLRVAFQGAPGAYSEFAAKTALPGCDTVPCRAFADALAAVERGGADRAILPVESTMEGTALRNYDLLLRHGLVVVQEINLFVHYCLLAMPGVRAAEVRRVISHPMALAHCGRALARLGVDREPVEDTAGAVEMLRSKRMLDTAAIASPRAADLYGLQVLAHGLQDESWNVTRFLLLSRPPSPVAVALGVDADAKTSMVVAHRGGSMVVVLKVLSAFSSRNINLTKLEVINNEGAGSGPGERPPVVILDTSARGAPTLRAFPHVLYVDCEGAAHDPRVREAIQEMERFAVFVRVLGCYAADSTVYDLQ

SEQ ID NO: 10335 - protein, 408 aa, Panicum virgatum
LPNPRRTRHRSSSSVSFVPAAAARANGVDGRAPEKKPPPPKGKARINGVNGKKGANGHVNGNKGVNGHVNGNKGVNGHVNGHADRIHLSVSTGGGGAGAQDGSGLRVAFQGAPGAYSEFAAKTALPGCDTVPCRTFADALAAVERGAADRAILPVESTMEGTTLRNYDLLLRHGLVVAQEINLFVHYCLLAMPGVRAAEVRRVISHPMALAHCGRALARLGVDREPVEDTAGAVEMLRSNRMLDTAAIASPRAADLYGLDVLAHGLQDESWNVTRFLLLSRPPSPVALHVDADAKTSMVVAHRGGSMMVLLKVLSAFSSRNINLTKLEVINNDGDAAGAGARPPVMILDTTARGAPTLRAFPHVLYVDCAGAAHDPRVREAIQEIEKFAVFVRVLGCYAADSTVYDLQ

SEQ ID NO: 10336 - protein, 871 aa, Zea mays
MSASASAGKLAAALHRRTRRVTSALACAALEWVLIALLLVNGLLAYAVARFADYFGLSPPCLLCSRVDRLFQAEGGGGGDASGAGARWLRDALCDAHAAEISALGYCLRHRRLAEAGEMCVGCRPSSWKERTSDAGACACCEAAAVLRASPVRELEDTTRDARVSEKEVEDGDQGYVLLAQDDHEEEPDEVENRQQEPQSEVDGRQHLEDEVMAAVQDESLEFMDQVEDITIEDDRLVSVVALDEMTIADDSGLHRDVEEVDGTNHVVEDEQDPRDVDVGAVLEEKRMLDSSVATPVDLTEDSVVPTSPVPCPETSTDPSHPDHSSVSQDDGDVLEDTSTAEEEHIFVPQASVSEAVSEDDNRTAAEVDTNCEVSIGSDICEREQDEHVVPFQDLAAFEELVAPLATGDDLPLPSEVLEPPDQVEAGEVEQEDVTTSTGLDLQPNEQNEIEEDRAPETPTNSVATQRSDRMFLLERKRSLSLSLDGSVASEMEGSEPSTVDQLKSALQAERKALGALYAELEEERNAAAIATNQTMAMINRLQEEKAAMQMEALQYQRMMEEQSEYDQEALQLLNELVSKRAREKQELERELELYRQKVQHYEDKERRRTASFKANGVSPSGSGTSVSSSGEDSDGHSDDYCELGDSPDGGNVQSSSDAALSSMRDQDDGTKHLAALDDSLTYFEVERLSILEELKTLEERLFTLEDDDINTSKEVTGHSSSDMDLPHDGLQSPEYILTGDRPRFGGRASISRGKSLLPLFDAVGDEACDRMPPSAGAGEADQADDAATKPASVLVKEQERLAIIEEVDHVYERLQALEADKEFLRHCIKSLKKGDKGMDLLQEILQHLRDLRSVELHVKNAGGAMAANSA

SEQ ID NO: 10337 - protein, 141 aa, Zea mays
MDEEEREEVGEYKLQGLVGRGSFAEVHRAAHRRTGAPAAVKAIDRRLVDKRVHDGILQEREILRSIDHPNILRLLDTIDTTNMMYLVLEYCDGGDLDAFLHKHGRLPEAVAKDLMRQLAEGLKVLRGRNIVHRDLKPQALF

SEQ ID NO: 10338 - protein, 366 aa, Setaria italica
MERAVRELWAESRDLLGLGSPSPDDTAAKASAVPRADLPPTPLAFLRDHVSPGRPLIVSAAATRHWPAASLWPTASYLTDALRSTTVSLHLTPDGRADALAPHPGRHESSSKCFASAHVRRVDFPAAVRLIRGSDPAAGLVAYAQQQDDCLRGEYAAVAGDVDAHVPWASEALGCLPEAVNLWIGNAHSVTSFHKDHYDNIYAVVSGEKHFLLLPPTEHHRLYVRDYPAAHYVAEEKDAGGEHQMRLKLELDEPERIVPWSSVDPCPASPEELDAQASSFPLYSDGPAPIRCTVRAGEMLYLPSMWFHHVSQSPGPNGLTIAVNYWYDMHFDIKYAYFNFLRSMEIDGCSSGKSGFLEGDLEEKND

SEQ ID NO: 10339 - protein, 359 aa, Oryza sativa
MERAVRELWAESRDLLGLHSPDDAAAADAAMPRAEMPPTPLAFLRDHVSPGRPLLVSSAATSHWPAASLWPTDSYLTDALRSTAVSLHLTPDGRADALAPHPRPSHPGAKCFASAHVRQVDFPTAVRLIRSSDPASGLVAYAQQQDDCLRGEYAAVAGDVDAHVPWASDALGCLPEAVNLWIGSACSQTSFHKDHYDNIYVVVSGEKHFLLLPPTEHHRLYVRDYPAAHYAAEDEAELRLKLELEEPERIVPWSSVDPYPPSPEEAAAQASSFPLYFEGPRPIRCTVRAGEMLYLPSMWFHHVSQSPGPNGLTIAVNYWYDMQFDIKYAYFNFLRSLEIDGSSSKKTDALEDDLEETND

SEQ ID NO: 10340 - protein, 353 aa, Hordeum vulgare
MERSVRELWAESRELLGLHSPDAVPRADLPPTPLAFLRDHVSPGRPLLVSAAATRHWPAASLWPTESYLSDALRSTDVSVHLTPDGRADALAAHPRRPGARCFASAHVRRVDFPAAVRLIRDSDPEAGLVAYAQQQDDCLRGEYAAVAGDVDAHVPWASEALGCLPEAVNLWIGNSCSVTSFHKDHYDNIYVVLSGEKHFLLLPPTEHHRLHVREYPVAGYAPVKEGEEVPKLKLEMEEPERVVPWSSVDPYPASPEEMAAEASSCPLYFKGPMPIRCTVRAGEMLYLPSMWFHHVSQSPGPNGLTIAVNYWYDMQFDIKYAYFNFLRSLEIKDSPLENNVDAFEGELEEKDD

SEQ ID NO: 10341 - protein, 509 aa, Hordeum vulgare
MAKGAVAGTAVVACAAAAAAAAVGVAVVVSRRRRRTRDAEAGRRKKVADVIGELEQTLATPTPLLRGIADAMVEEMERGLRADPHAHAPLKMLISYVDNLPTGDEHGLFYALDLGGTNFRVLRVQLAGKEKRAVQQYEEVPIPPHLMVGTSTELFDFIAAELERFVETEGDDFHLPEGRHRELGFTFSFPVHQTSISSGTLVKWTKGFCINGTVGEDVVAELSSAMERQGLDMKVTALVNDTVGTLAGGIYADNDVVAAVILGTGTNAAYVEHVDAIPKWKGPLPRSGNMVINMEWGNFKSDKLPRSDYDIALDFESLNPGEQMYEKMISGMYLGEVVRRILLRLAHDASLFGDVVPPKLEKLFVLRTPDMSAMHHDTSHDLKHLGAKLKDILGVADTSLEARYITLHVCDKVAERGARLAAAGIYGILKKLGRDRAPSHGSPKQRTVVAIDGGLYEHYKKFSSRVEATLAELLGEAAASSVVVKMANDGSGIGAALLAASHSQYNVLG

SEQ ID NO: 10342 - protein, 496 aa, Triticum aestivum
VVCAAAAAAAAVGVAVVVSRRRRRTRDAEAGRRKKVADVIEELEQTLATPTPLLRGIADAMVEEMERGLRADPHAPLKMLISYVDNLPTGDEHGLFYALDLGGTNFRVLRVQLGGKEKRAVQQYEEVPIPPHLMVGTSTELFDFIAAELERFVETEGDDFHLPEGRHRELGFTFSFPVHQTSISSGTLVKWTKGFCINGTVGKDVVAELSSAMERQGLDMKVTALVNDTVGTLAGGIYADNDVVAAVILGTGTNAAYVEHVDAIPKWKGPLPRSGNMVINMEWGNFKSDKLPRSDYDIALDFESLNPGEQMYEKMISGMYLGEVVRRILLRLAHDASLFGDVVPSKLEKLFVLRTPDMSTMHHDTSHDLKHLGAKLKDILGVADTSLEARYITLHVCDKVAERGARLAAAGIYGILKKLGRDRAPSDGSPKQRTVVAIDGGLYEHYKKFSSRVEATLAELLGEAAASSVVVKMANDGSGIGAALLAASHSQYNVVE

SEQ ID NO: 10343 - protein, 475 aa, Triticum aestivum
AAAFGTRRRGQAEEVADVIEELEQTLATPTPLLRGIADAMVEEMERGLRADPHAPLKMLVSYVDNLPTGDEHGLFYALDLGGTNFRVLRVQLGGKEKRAVQQYEEVPIPPHLMVGTSTELFDFIAAELERFVETEGDDFHLPEGRHRELGFTFSFPVHQTSISSGTLVKWTKGFCINGTVGEDVVAELSSAMERQGLDMKVTALVNDTVGTLAGGIYADNDVVAAVILGTGTNAAYVEHVDAIPKWKGPLPRSGNMVINMEWGNFKSDKLPRSDYDIALDFESLNPGEQMYEKMISGMYLGEVVRRILLRLAHDASLFGDVVPSKLEKLFVLRTPDMSAMHHDTSHDLKHLGAKLKDILGVADTSLEARYITLHVCDKVAERGARLAAAGIYGILKKLGRDRAPSGGCPKQRTVVAIDGGLYEHYKKFSSRVEATLAELLGEAAASSVVVKMANDGSGIGAALLAASHSQYNVVE

SEQ ID NO: 10344 - protein, 758 aa, Zea mays
MATPFPLEADEGEARELLYEAYNELHALASELGGAAAAPAVVVVGHQTDGKSALVEALMGFQFNHVGGGTKTRRPVALHLRFNPRCDEPQCRLLSATGDAEEHDEAGVAARPMPLADIQAYIEAENLRLENDPCQFSEKEIIIKVEYKHSPNLTIIDTPGLILPAPGRKNRVLQSQASAVESLVRAKIQHKETIILCLEDCSDWSNATTRRVVMQVDPDLARTVLVSTKLDTKIPQFARPSDVEVFLHPPNCVLDVSLLGDSPFFTSVPSGRVGSCHEAVFRSNGEFKKAILSRELEDIASIEDKLGRSLTTMEKDRIGVGNLRLYLEELLQKRYIKSVPLIIPLLEKQHRNTTSKLREISHELSDLDETKLKEKAQLFHDTFLTKLSLLLKGMVVAPPDKFGETLVNERINGGTFTGSENFQLPNKMMPNGGMRLYGGAQYHRAMAEFRLVVGSTRCPPITRDEIVNACGVEDIHDGTNYSRTACVIAVAKARDTFEPFLDQLGFRLLYILKRLIPISVYLLEKDGEHFSSHEVLIRRVQEAFKRFVESTEQSCRQRCMEDLESTTRYVTWSLHNKNRAGLRHFLDSFVAPEQLSVNTLNERFSGLNDNKQDKAKGDSKSNHSPDTNSSTAMPETRLVDLLDSTLWNRRLVPSSERLVYALVHQIFHGIKEHFLVTTELKFNCFLLMPIVDKLPALLRQDLESAFEEELDSIFDVTQLRQSLGQKKRELEIELKRIKRLKEKFGEINKKLNSLQVRQ

SEQ ID NO: 10345 - protein, 764 aa, Setaria italica
MATPPLPPDSKAGAEEEEEEEARELLYEAYNELQALAAELGGAAGAPAVVVVGHQTDGKSALVEALMGFQFNHVGGGTKTRRPVALHLRFNPRCDAPRCRLLAGPGDEVEDAGVAGRPMPLADIQAYIEAENMRLENDPCQFSEKEIIIKVEYKHCPNLTVIDTPGLILPAPGRKNRVLQSQASAVESLVRAKIQHKETIILCLEDCSDWSNATTRRVVMQVDPDLARTVLVSTKLDTKIPQFARPSDVEVFLHPPTCVLDVSLLGDSPFFTSVPSGRVGSCHEAVFRSNEEFKKAISSRESEDIVSIEDKLGRSLTTEEKERIGVSNLRLFLEELLRKRYIESVPLIIPLLEKEHRNATRKLREISQEISDLDEAKLKEKAQLFHDSFLTKLSLLLKGMVVAPPDKFGETLINERINGGTFTGSENFQLPNKMMPNAGMRLYGGAQYHRAMAEFRLVVGSIKCPPITREEIVNACGVEDIHDGTNYSRTACVIAVAKARDAFEPFLHQLGFRLLYILKRLIPISVYLLEKDGERFSSHEVLVRRVQAEFKRFAESTEQSCRERCMEDLESTTRYVTWSLHNKNRAGLRHFLDSFAAPEQLSVNTLHEQLPGLNENKQDRPKGDPKSNHSSDTNSSGAVPETRLVDLLDSTLWNRRLVPSSERLVYALVHQIFHGIKEHFLVTTELKFNCFLLMPIVDKLPALLRQDLELAFEDELDSIFDVTQMRQSLGQKKRELEIEVKRIKRLKEKFGEINKKLNSLQVRQ

SEQ ID NO: 10346 - protein, 772 aa, Brachypodium distachyon
MATLPPEQLTLGEEAEEARGLLYEAYNELQRLAAELGGAAVPAPAVVVVGHQTDGKSALVEALMGFQFNHVGGGTKTRRPIALHLRFNPRCDVPHCRLLAGSGEGDADDDEDGAVDRPMPLADIQEYIEAENMRLENDPCQFSEREIIIKIEYKHCPNLTIIDTPGLILAAPGRKNRVLQSQACAVEALVRAKIQHKETIILCLEDCSDWSNATTRRVVMQVDPDLARTVLVSTKLDTKIPQFARASDVEVFLHPPTCVLDGSLLGDSPFFTSVPSGRVGSCHEAVFRSNEEFKKAISLREFEDVASLEDKLGRSLTKEEKNRIGLSNLRLFLEELLQKRYIESVPSIIPLLEKEHRAATRNLRKVTEEISDLDEAKLKEKARLFHDSFLTKLSLLLKGMVVAPPDKFGETVINERINGGTFTGSENFQLPNKMMPNAGMRLYGGAQYHRAMAEFRLVVGSIKCPPITREEIVNASGVEDIHDGTNYSRTACVIAVAKARDTFEPFLHQLGFRLLYILKRLSPISVFLLEKDGEHFSRHDVLVKRVQAAFNRFAESTEQSCRERCMEDLESTTRYVTWSLHNKNRAGLRHFLDSFVAPEQLSASTHTAANSAGLHEQSSGLNDNKQDKPKGDLKSSHPLDSNPSSVVSETRLVDLLDSTLWNRRLAPSSERLVYALVHQIFHGIKEHFLVTTELKFNCFLLMPIVDKLAALLREDLESAFEDDLDSIFNVNQLRHSLGQRKRELEIELKRIKRLKEKFGQINKNLNSLQVRQ

SEQ ID NO: 10347 - protein, 773 aa, Triticum aestivum
MATPRPELLSPDEDEEESARGLLYEAYNELQRLAAELGGAAVPVPAVVVVGHQTDGKSALVEALMGFQFNHVGGGTKTRRPIALHLRFNPRCHSPNCRLLAGSGEGDAEDDAGAADRSMLLADIQAYIEAENKRLENDPSQFSAKEIIIRIEYKHCPNLTIIDTPGLILAAPGRKNRVLQSQACAVEALVHAKIHHKETIILCLEDCSDWSNATTRRVVMQVDPDLVRTVLVSTKLDTKIPQFARASDVEVFLHPPTCVLDGSLLGDFPFFTSVPSGRVGSCHEAVFRSNEEFKKAISLRELDDVTSLEDKLGRSLTREEKNRIGVSNLRLFLEELLQNRYIESVPSIIPLLEKEHRAASRKLRKVTQEISDLDEAKLKEKARLFHDSFLTKLSLLLKGMVVAPPDKFGETSVNERINGGTFTGSENFQLPNKMMPNAGMRLYGGAQYHRAMAEFRLVVGSIKCPLITREEIVNACGVEDIHDGTNYSRTACVIAVAKARDTFEPFLHQLSFRLLYILKRLSPISVFLLEKDGEHFSSHDVLVKRVQAAFNRFAESTEQSCRERCMEDLESTTRYVTWSLHNKNRAGLRHFLDSFVAPEQLCANTHTAHSAGLHEQSTGLNDSKQDRPKGELKSSHTSDSNPSGGVSETRLVDLLDSMLWNRRLAPSSERLVYALVHQIFHGIKEHFLVTTELKFNCFLLMPIVDKLAALLREDLESAFEDDLDSIFSVTQLRRSLGQKKRELEIELKQMKRLKEKFTEINKKLNCLQVRQQA

SEQ ID NO: 10348 - protein, 559 aa, Oryza sativa
MATPPESLSPAAAAVEDDWEEARGLLYEAYNELQGLAAELGGAAAPAPAVVVVGHQTDGKSALVEALMGFQFNHVGGGTKTRRPVALHLRFNPRCHAPRCRLLAGSGAGDDEDEEAGVAGRAMPLADIQAYIEAENMRLENDPSQFSEKEIIIRIEYKHCPNLTIIDTPGLILPAPGRKNRVLQSQACAVETLVRAKIKHKETIILCLEDCSDWSNATTRRVVMQVDPDLARTVLVSTKLDTKILQFARASDVEVFLHPPTCALDGSLLGDYPFFTSVPSGRVGSCHEAVFRSNEEFKKAISLRELEDVASLEDKLGRGLTKEEKNRIGVSNLRLFLEELLRKRYIESVPLIIPLLEKEHRGATRKLREVNQEISDLDEAKMKEKARLFHDSFLSKLSLLLKGMVVAPPDRFGETLINERINGGTFTGSENFLIPNKLMPNAGMRLYGGAQYHRAMAEFRLVVGSIRCPPITREEIVNACGVEDIHDGTNYSRTACVLAVAKARDTFEPYLHQLGFRLLYIMKRLIPISAFLLEKDGENCSSHDVLVKRVKAVNLIEFA

SEQ ID NO: 10349 - protein, 175 aa, Saccharum officinarum
MASYPLLLLLLLAATAAAAAAAAGEASRGNATATSSSPTAYEMLERYDFPRGILPAGVSGYELRGDGSFEVYFPRPCEFLLAGRWLVRYEARVRGSVAAGSLTALDGISVKVLFLWLGVGEVDRAGDTLSFYVGPVATSFPLADFAESPRCRGYDDGAGAADDDDDFFPAAAASS

SEQ ID NO: 10350 - protein, 225 aa, Cajanus cajan
MMKRVLCLLAFLYAVHETHAVEYSVTNNALATPGGVAFRDKIGAEYAKQTLDSATKFIWNVFQQNNPADRKNVQKVSLFVDDMDGVAYTSNDQIHLSARYVGNYNGDVKREITGVLYHEMVHVWQWNGNGGAPGGLIEGIADYVRLKANYAPSHWVKPGQGQKWDQGYDVTARFLDYCDSLKSGFVAQLNKLMRSGYSDQFFVQLLGKSVDQLWRDYKAKYGNIA

SEQ ID NO: 10351 - protein, 225 aa, Phaseolus coccineus
MIKQALCFLVFLHAFHQTHAVQYAVTNRALTTSGGVAFRDKIGEQYAKQTLDSATQFIWRILQQSNPADRKNVQRVSLFVDDMDGVAYTSGDQIHLSARYVGKYNGDVKKEISGVLYHEMVHVWQWNGNGRVPGGLIEGIADYVRLKANYAPSHWVKPGQGQKWDQGYDVTARFLDYCESLRSGFVAQLNKLSRSGYSDQYFVYLLGKPVDQLWRDYKAKYGNIA

SEQ ID NO: 10352 - protein, 223 aa, Cajanus cajan
MILHGLCFLVFLSATHAVKFSVTNNALTTPGGAAFRDKIGAAYAQRTLIAATRVTLKDIFQQNNLADRKNVQKISLFVDDMDGVAYTSNDEIHVSAKYVGKYKGDVKTEITGVLYHEVVHVWQWNGNGGAPGGLIEGIADYVRLKANYAPSHWVKPGQGQKWDQGYDVTAHFLDYCDSLKSGFVAQLNKLMRSGYSDQFFVQLLGKPVDQLWRDYKAKYGNIA

SEQ ID NO: 10353 - protein, 224 aa, Medicago truncatula
MHTLYFFLVLLAIIHGIQAVDYSVTNNALSTPGGVRFRDQLGAQYATQTLDSATQFIWRVFQQNNPADRKNVQKVSLFVDDMDGVAYTSNNEIHLSARYVNSYGGDLRKEITGVLYHEMTHVWQWNGNGQANGGLIEGIADYVRLKANYAPSHWVKPGQGNKWDQGYDVTARFLDYCDTLRSGFVAELNKLMRNGYSDQFFVQLLGKTVNQLWTEYKAKYGNIA

SEQ ID NO: 10354 - protein, 130 aa, Flaveria ramosissima
MATVSSLFVLLLTITTVFICNAEASSVDFVKKTVSSHPIVIFSKSYCPYCRRAKGVFKELNKKPYVVELDERDDGSDIQDALSEMVGRRTVPQVFINGKHLGGSDDTVEAYQSGELAKLLGIDSSHKTDL

SEQ ID NO: 10355 - protein, 62 aa, Ambrosia trifida
MAKTVAISSILILVLLTIFISNSQAASSSVKFVRKPSLLIPLSSSPNLTVRIVKGLKVCLRS

SEQ ID NO: 10356 - protein, 133 aa, Lactuca sativa
MARSATIPFICIILLTITAFYMCNGEESSVDFVKKTVSSHPIVIFSKSYCPYCKRAKGVFKELNKKPYVIELDEREDGGKIQNALGELVGRRTVPQVFINGKHLGGSDDTIEAYESGELAELLGISSSHKTDL

SEQ ID NO: 10357 - protein, 433 aa, Ambrosia trifida
MGEWVIGAFINLFGSIAINFGTNLLKLGHDERDRHAMLGEGIDGKTILRPIISFQSWRIGILFFAFGNALNFISFGYAAQSLLAALGSVQFVSNIAFAYFVLNKTVTVKVLVATTFIVLGNTFLVAFGNHQSPVYTQEQLAEKYSNITFLFYCLFLVVVVVMHHYVYRRGELLLAIPGKELTAYWKLLLPFSFAVVSGAVGSCSVLFAKSLSNLLRLSMSSSYRLDSWFTYSILLLFLSTAGFWMARLNEGLSQFDAILIVPMLQIAWTFFSICTGFVYFQEYQVFDALRTVMFIVGMISVFIGISLLAPDDSKGAEVKDSPSSKVNTDVERLIEDSSIKDMKSFARAMATKASAAVIRAKSACTLMLGMGDDTMHASSVFAMPMVSSKMTGFRGVNSDRSKLLSLRSPSGWNRIPVVEETVNMMDSISSEED

SEQ ID NO: 10358 - protein, 427 aa, Flaveria ramosissima
MGEWVIGAFINLFGSIAINFGTNLLKLGHDERDRHATLGEGIDGKTILRPIISFQSWRIGILFFAFGNALNFISFGYAAQSLLAALGSVQFVSNIAFAYFVLNKTVTVKVLVATTFIVLGNTFLVAFGNHQSPVYTQDQLAEKYSNITFLFYCLLLAVVVIMHHYVYRKGELLLANGKELMPYWKLLLPFSFAVVSGAIGSCSVLFAKSLSNLLRLSMSSSYRLDSWFTYSILLLFLCTAGFWMARLNEGLSLFDAILIVPMFQIAWTFFSICTGFVYFQEYQVFDALRTVMFILGMISVFLGISLLAPDDSKVGEVKDSTSSKVNTDVERLIEDSSIKDMKSFARAMATKASAAVIRAKSACTLLLGMGDDTMHASSVLAMPMVSSKMTGFRGVNSDRSKLLSLKSQSGWNRIPMVEETVNMMDSI

SEQ ID NO: 10359 - protein, 439 aa, Cirsium arvense
MGEWVIGAFINLFGSIAINFGTNLLKLGHDEREKHAVLGNGGINGKMLLKPIISFQSWRIGILFFAFGNALNFISFGYAAQSLLAALGSVQFVSNIAFAYFVLQKTVTVKVLVATTFIVLGNTFLVAFGNHQSPVYTQEQLAEKYSNTTFLFYCLLLILVVVMHHYVYRRGELLLAIPGKDLMPYWKLLLPFSFAVVSGAIGSCSVLFAKSLSNLLRLSMSSSYRLDSWFTYSILLLFLCTAGFWMARLNEGLSQFDAILIVPMFQIAWTFFSICTGFVYFQEYQVFDALRTAMFILGMISVFIGISLLAPDDSKGGEVKENTLSSVASSNVNTDVDRLVKPCEDSPIKDLKSLARAMVTKAIAAAMKAKSTCSLLVGMGDDTMHASSVLAMPMVSSKMTGFRGGDRSKLISLRSPTGWSRIPVEETVNMLDTTSSEED

SEQ ID NO: 10360 - protein, 439 aa, Cirsium arvense
MGEWVIGAFINLFGSIAINFGTNLLKLGHDEREKHAVLGNGGINGKTILKPIISFQSWRIGILFFAFGNALNFISFGYAAQSLLAALGSVQFVSNIAFAYFVLQKTVTVKVLVATTFIVLGNTFLVAFGNHQSPVYTQEQLAEKYSNTTFLFYCLLLIWVVVMHHYVYRKGELLLAIPGKDLMPYWKLLLPFSFAVVSGAIGSCSVLFAKSLSNLLRLSMSSSYRLDSWFTYSILLLFLCTAGFWMARLNEGLSQFDAILIVPMFQIAWTFFSICTGFVYFQEYQVFDALRTAMFILGMISVFIGISLLAPDESKGGEVKENILSSVASSNVNTDVERSAKPCEDSPIKDLKSLARAMVIKAAAAAMKAKSACSLLVGMGDDTMHASSVLAMPMVSSKMTGFRGGDRSKLISLRSPTGWSRIPVEDTVNMLDTTSSEED

SEQ ID NO: 10361 - protein, 439 aa, Centaurea maculosa
  misc_feature (159)..(159): Xaa can be any naturally occurring amino acid
  misc_feature (163)..(163): Xaa can be any naturally occurring amino acid
  misc_feature (437)..(437): Xaa can be any naturally occurring amino acid
MGEWVIGAFINLFGSIAINFGTNLLKLGHDEREKHAVLGNGGINGKTILKPIISFQSWRIGILFFAFGNALNFISFGYAAQSLLAALGSVQFVSNIAFAYFVLQKTVTVKVLVATTFIVLGNTFLVAFGNHQSPVYTQEQLAEKYSNTTFLFYCLLLIXVVVXHHYVYRRGELLLAIPGKDLMPYWKLLLPFSFAVVSGAIGSCSVLFAKSLSNLLRLSMSSSYRLDSWFTYSILLLFLCTAGFWMARLNEGLSQFDAILIVPMFQIAWTFFSICTGFVYFQEYQVFDALRTAMFILGMISVFIGISLLAPDESKGGEVKENILSSVASSNVNTDVERSAKPCEDSPIKDLKSLARAMVIKAAAAAMKAKSACSLLVGMGDDTMHASSVLAMPMVSSKMTGFRGGDRSKLISLRSPTGWSRIPVEDTVNMLDTTSSXED

SEQ ID NO: 10362 - protein, 403 aa, Arnica chamissonis
MMRETDIAMLGEGMDGKTILRPIISFQSWRIGILFFTFGNALNFISFGYAAQSLLAALGSVQFVSNIAFAYFVLNKTVTVKVLVATTFIVLGNTFLVAFGNHQSPVYTQEQLAEKYSNITFLFYCLLLVVVVVMHHYMYRRGELLLAIPGKELMPYWKLLLPFSFAVVSGAVGSCSVLFAKSLSNLLRLSMSSSYRLDSWFTYSILLLFLCTAGFWMARLNEGLSQFDAILIVPMFQITWTFFSICTGFVYFQEYQVFDALRTVMFILGMISVFIGISLLAPDDSKGGEVKDSPSSKVNTDAERLIEESPIKDMKSLAIAIATKASAVVIRAKSTCTLVLGMGDDTMHASSVLAMPMVSSKMTGFRGGERSKLLSLRSPSGWNRIPVVEETVNMLDTISSEED

SEQ ID NO: 10363 - protein, 441 aa, Artemisia annua
MGEWVIGAFINLFGSIAINFGTNLLKLGHDERERHAVLGEGINGKTILRPIISFQSWRIGILFFAFGNALNFISFGYAAQSLLAALGSVQFVSNIAFAYVVLNKTVTVKVVVATTFIVLGNTFLVAFGNHQSPVYTQDQLAEKYSNITFLFYCLLLVVVVIIHHYIYRRGEWLLSIPGKDFSPYWKLIIPFSYAVVSGAIGSCSVLFAKSLSNLLRLSMSSSYRLDSWFTYSILLLFLCTAGFWMARLNEGLAQFDAILIVPMFQIAWTFFSIITGFVYFQEYQVMDILRTVMFILGMISVFIGISLLAPDEPKGGEVKDSSLSSAALPRVNTEVERLIKPIEDSPIKDLKSFTRALAAKASAAVTRAKSTCTLLLGMGDDAMHGSSVFAMPMVSSKMTGFRGVGGDRSKLMSLRSPTGWSRIPVVEENVNMLETTSSGED

SEQ ID NO: 10364 - protein, 384 aa, Ambrosia trifida
MGEWVIGAFINLFGSIAINFGTNLLKLGHDERDRHAMLGEGIDGKTILRPIISFQSWRIGILFFAFGNALNFISFGYAAQSLLAALGSVQFVSNIAFAYFVLNKTVTVKVLVATTFIVLGNTFLVAFGNHQSPVYTQEQLAEKYSNITFLFTVYFGGSGCHASLCIQERRIAACYSRERTHGLLETTASLFICCSFRGRRIVFGLFAKSLSNLLRLSMSSSYRLDSWFTYSILLLFLSTAGFWMARLNEGLSQFDAILIVPMLQIAWTFFSICTGFVYFQEYQVFDALRTVMFIVGMISVFIGISLLAPDDSKGAEVKDSPSSKVNTDVERLIEDSSIKDMKSFGRAMATKASAAVIRAKSACTLMLGMGDDTMHASSVFAMPM

SEQ ID NO: 10365 - protein, 383 aa, Helianthus annuus
MGDWVIGAFINLFGSIAINFGTNLLKLGHDERGRHSMLGERINGKTILKPIISFQSWRIGILFFAFGNALNFISFGYAAQSLLAALGSVQFVSNIVFAYFVLNKTVTVKVIVATTFIVVGNTFLVAFGNHQSPVYTQDQLAEKYSNITFLFYCLLLVAVVAMHHYVYRRGELLLAISGKELMRYWKLLLPFSFAVVSGAIGSCSVLFAKSLSNLLRLSMSSSYRLDSWFTYSILLMFLCTAGFWMTRLNEGLAQFDAILIVPMFQIAWTFFSICTGFVYFQEYQVLNALRTVMFILGMISVFIGITLLAPDESKGGEVMDIPVSSKVNTDVERLIEDSPINDMKSLARAMATKALAAVGRAKVVRIIISYRNEIRRWNRNIVS

SEQ ID NO: 10366 - protein, 214 aa, Cichorium intybus
MGEWVVGAFINLFGSIAINFGTNLLKLGHDERERHAILVEGINGKTLLRPIISFQSWRIGILFFAFGNALNFISFGYAAQSLLAALGSVQFVSNIAFAYFVLQKTVTVKVIVATTFIVLGNIFLVAFGNHQSPVYTQEQLAEKYSNITFLFYCLLLVVVVLMHHYVYRRGELLLAIPGKDLMRYWKLLLPFSFAVVSGAIGSCSVLFAKSLSIF

SEQ ID NO: 10367 - protein, 145 aa, Flaveria ramosissima
MGDWVIGAFINLFGSVAINFGTNLLKLGHDERERHSMLGEGINGKTILRPIISFQSWRIGILFFAFGNALNFISFGYAAQSLLAALGSVQFVSNIAFAYFVLNKTVTVKVLVATTFIVFGKHLPCRIWQSPITSLHTRPVGREVH

SEQ ID NO: 10368 - protein, 375 aa, Flaveria ramosissima
FGSIAINFGTNLLKLGHDERERHSMLGEGINGKTILRPIISFQSWRIGILFFAFGNGLNFISFGYAAQSLLAALGSVQFVSNIAFAYFVLNKTVTVKVLVATTFIVFGNTFLVAFGNHQSPVYTQDQLAEKYINITFLFYCLLLVAVVAMHHYVYRRGELLLAIHGKELRRYWKLLLPFSFAVVSGAIGSCSVLFAKSLSNLLRLSMSSSYHLDSWFTCSILLLFLCTAGFWMVRLNEGLAQFDAILIVPMFQIVWTFFSICTGFVYFQEYQVLNALRTVMFILGMISVFIGISLLAPDDTKGGEVMDSPLSSITSSKVNTDVERLIEDSPIKDMKSLARAMPTKSLAVVVRAKAVEILVPYWKGIKRWNQNMIS

SEQ ID NO: 10369 - protein, 427 aa, Helianthus annuus
MEEITNGGNKNESQLLKLKCSVQNYDWGRIGYDSRVATLFEKNCGVQIDEKKHYAEFWMGTHVSGPSVVDAGDGDNVSLKVWIVQNPKVLGDVVVDKWGVDLPFLLKVLSVGKSLSIQAHPDKELAGFLHKTQPNVYKDANHKPEMALALTEFEALCGFISSEELDVVLETVPEINEVVGNASANQILTVDKHIGELKEERALQSIFTKLMSVDQEVISEALSKLVNRLTHEKEKRRLTSKEELVLKLEKEYPNDVGVLAALLFNHVKLEPGDGLYIAANEPHAYLNGECIECMAASDNVVRAGLTPKYIDVKTLCSMLTYKQGLPEILKGVPMNQYVRRYTPPFEEFEVDQCVLDQGASVVFPALPGPSVFVVISGEGTMATASREDRVSEGDALFAPAGTEVHVSTDTELQLYRAGVNHKVLLNP

SEQ ID NO: 10370 - protein, 423 aa, Helianthus annuus
MEGGNKNEPELLKLKCSVQNYDWGRIGYDSRVASLFEKNCGVQIDDKKHYAEFWMGTHVSGPSVVDAGDGDNVSLKVWIVQNPKVLGDVVVDKWGVDLPFLLKVLSVGKSLSIQAHPDKELAGFLHKTQPNVYKDANHKPEMALALTEFEALCGFISSEELDVVLETVPEINEVVVNASANQILTVDKHIGELKEERALQSIFTKLMSVNQEVISKALSKLVNRLTHEKEKRRLTSKEELVLKLEKEYPNDVGVLAALLLNLVKLEPGDGLYIAANEPHAYLNGECIECMAASDNVVRAGLTPKYIDVKTLCSMLTYKQGLPEILKGVPINQYVRRYTPPFEEFEVDQCVLDRGASVVFPALPGPSVFVVISGEGTMATSSCEDRVSEGDALFAPAGTEVRVSTDTELQLYRAGVNHKVLLNP

SEQ ID NO: 10371 - protein, 361 aa, Ambrosia trifida
MGDDNNNNNNVSLKDWVVQNPEVLGDVVVDKWGLDLPFLLKVLSVGKSLSIQAHPDKELAGFLHKTQPNVYKDANHKPEMALALTEFEALCGFISSEELDAVLETVPEIADVVGNANADQLLDVDKHNGEVKEERNLQSIFTKLMSVDKEVISKALSRLVNRLTRENETRQLTSKEELVLKLEKQYPNDVGVLAALLLNLVKLEPGDGLYIAANEPHAYLNGECIECMAASDNVVRAGLTPKYIDVKTLCSMLTYKQGLPEILKGVPINQYVRRYTPPFEEFEVDQCVLDQAASVVFPALPGPSVFVVISGEGTMLTSSCEDRVSEGAALFAPAGTEVRVSTESELQLYRAGVNHKVLMNP

SEQ ID NO: 10372 - protein, 182 aa, Ambrosia trifida
MGDDNNNNNNVSLKDWVVQNPEVLGDVVVDKWGLDLPFLLKVLSVGKSLSIQAHPDKELAGFLHKTQPNVYKDANHKPEMALALTEFEALCGFISSEELDAVLETVPEIADVVGNANADQLLDVDKHNGVVKEERNLQSIFTKLMSVDKEVISKALTRLVNRLTRENETRQLTRQRRTSVEA

SEQ ID NO: 10373 - protein, 423 aa, Flaveria ramosissima
MESNGDPNHQSPLLKLKCSVQNYDWGRIGHDSRVARLFQSNSGAQIDDNKHYAEFWIGTHVSGPSFVDGFLDLSLKSWILQNPKVLGDVVVDKWGNDLPFLLKVLSVGRSLSIQAHPDKELAGFLHKLQPNVYKDANHKPEMALALTEFEALCGFISSEELDVVLETVPEIKEVVGNACADQILTVNNHNGELKEESLLRSIFTKLMSADREVISKALTKLINRLTRENETRQLTTKEELVLKLEKQYPNDVGVLAALLLNLVKLEPGDGLYIAANEPHAYLNGECIECMAASDNVVRAGLTPKYMDVKILCSMLTYKQGLPEILKGVPLNQYVRRYTPPFEEFEVDQCVLDQGASVVFPGLPGPSVFVVISGEGTMRASSCEAQVSEGAALFAPAGTEVCVSTDSELQLYRAGVNSKVLLNP

SEQ ID NO: 10374 - protein, 282 aa, Ambrosia trifida
MALALTEFEALCGFISSEELDAVLETVPEIADVVGNANADQLLDVDKHNGEVKEERNLQSIFTKLMSVDKEVISKALSRLVNRLTRENETRQLTSKEELVLKLEKQYPNDVGVLAALLLNLVKLEPGDGLYIAANEPHAYLNGECIECMASSDNVVRAGLTPKYIDVNTLCSMLTYKQGLPEILKGVPINQYVRRYTPPFEEFEVDQCVLDQAASVVFPALPGPSVFVVISGEGTMLTSSCEDRVSEGAALFAPAGTEVRVSTESELQLYRAGVNHKVLMNP

SEQ ID NO: 10375 - protein, 329 aa, Ambrosia trifida
MGDDIIIYVSLKDWVVQNPEVLGDVVVDKWGLDLPFLLKVLSVGKSLSIQAHPDKELAGFLHKTQPNVYKDANHKPEMALALTEFEALCGFISLEELDVVLETVPEINEVIGNASADQILTVDKHNGEVKEESVLRSIFTKLMSADREVISNALSRLVNRLTHENETRQLTSKEELVLRLEKQYPNDVGLLAALLLNLVKLEPGDGLYIAANEPHAYLNGECIECMAASDNVVRAGLTPKYIDVKTLCSMLTYKQGLPEILKGVPINQYVRRYTPPFEEFEVDQCVLDQGASVVFPALPGPSVFVVISGEGTMVTSSCEDRVSEGAALF

SEQ ID NO: 10376 - protein, 233 aa, Ambrosia trifida
MGLQFRSLTMLVLLIWLFWWSRLEAQTLGPEFESARALDGILQDYAYRAFDRPRTGRVYDGVPPANLSGVQISAMRLRSGSLFTRGVRQYKEFTIPVGVIGTPYVERLVLVYQNLGNWSTTYYPLPGYVYLAPVLGLLAYDATNLSATNLEELDIRASEDPISIEFRQVQPVPDGSVARCVWFDLEGHKNFTNVVSGNKCVTYDQGHFSIVVESTAPLACTSGATTTTTASWR

SEQ ID NO: 10377 - protein, 264 aa, Solanum phureja
MRCFTILFFFSAIVVVALASNVEEVISQVVEIHRLRPQTGSAGYTVPQLDCLSWRLAVETNNLQNWKLVPKECTNYVGHYMLGKQYRRDCEYVAKQAIEYAKTLKLGGDGKDVWVFDIDETTLSNSPYYARSDVAFGAIAYNNTKFSAWLAEGKAPAIPSILGVYKTVLSLGIKPVFITGTRENFKQVRIVNLKKVGYSNWAALILKGENDSGSAVQFKSSKRTELVKAGYRIVGNIGDQWTDLIGENVGARTFKVPDPMYYIS

SEQ ID NO: 10378 - protein, 265 aa, Solanum melongena
MRPFTILFFFSAIVAVALASNVEDQVISQVVEIHRLRPQTGAAGYPVPQLDCLSWRLAVETNNLRDWKLVPEECKNYVGHYMLGKQYRQDCEYVANQAIEYAKSLKLSGDGKDVWVFDIDETTLSNLPYYARSDVAFGAIPYNNTKFNAWIAEGKAPAIPSILGVYKTVLSLGIKPVFITGTRENFKQIRITNLKKVGYSNWAALILKGENDSGSAVQFKSSKRTELVKAGYRIVGNIGDQWTDLIGENVGARTFKVPDPMYYIG

SEQ ID NO: 10379 - protein, 265 aa, Solanum melongena
MRPFTFLFFFSAIVAMALASNAEDQVISQVVEIHRLRPQTGAAGYPVPQLDCLSWRLAVETNNLRDWKLVPKECKNYVGHYMLGKQYRQDCEYVANQAIEYAKSLKLSGDGKDVWVFDIDETTLSNLPYYARSDVAFGAIPYNNTKFNAWTAEGKAPAIPSMLGVYETVLSLGIKPVFITGTRENFKQVRITNLNKAGYSNWAALILKGENDSGSAVQFKSSKRTDLVKAGYRIVGNIGDQWTDLIGENVGARTFKVPDPMYYIG

SEQ ID NO: 10380 - protein, 267 aa, Nicotiana tabacum
MRCFPLLFLISTIVAVTAVASTSNNVEVISQVVEIHRLRPQTGSAGYRVPQLDCLSWRLAVETNNLQNWKLVPSACENYIGHYILGKQYRHDCEAVANAAIEYAKSLKLGGDGKDVWVFDIDETTLSNLPYYARSDVAFGAIPYNNTKFNAWVAEGKAPAIPSILGVYKTVLSLGIKPVFITGTRESFKQVRIANLKKAGYSNWAKLALKGDNDSATAVEFKSSKRTELVKAGYRIVGNIGDQWSDLIGENVGSRTFKVPDPMYYIG

SEQ ID NO: 10381 - protein, 340 aa, Vaccinium corymbosum
GEEEDTQRLKKIAAAAYDYENDPRWADYWSNILIPPHLASRSDVVDHYKRKFYQRYIDPDLVVEAIASGSSSQSARPAPSSSSTPNGQARQRNSGSTTRTSGSSTTTAPTPTSLRWDRQTIHFSVNAWVFVVAVLAIIPLVPKNLSNRAYRLSFMGTACSSLYSLYSLYGKPRAWNLQALQVWFQSVIATKDFIYFIYCLTFVTSHLRLKFALIPVLCWALEHVAKFLRRNFSRSSLYRKYLEEPCVWVESNTTTLGILSSQAEIGLGFLLVLALFSWQRNIIQTFMYWQLLKLMYHAPVTAGYHQSVWAKIGRIVDPLVQRYAPFLNTPLSAVQRWWFR

SEQ ID NO: 10382 - protein, 225 aa, Secale cereale
MKLQAATVASFLLLALAATAQAVTFDASNKASGTSGGRRFNQAVGLPYSKKVLSDASAFIWKTFNQRAAGDRKPVDAVTLVVEDISGVAFTSANGIHLSAQYVGGISGDVKKEVTGVLYHEATHVWQWNGQGRANGGLIEGIADYVRLKAGFAPGHWVRPGQGDRWDQGYDVTARFLDYCDSLKPGFVAQLNAKMKSGYTDDFFAQILGKNVQQLWKDYKAKFRG

SEQ ID NO: 10383 - protein, 225 aa, Hordeum vulgare
MKLQVATVASFLLVALAATAQAVTFDASNKASGTSGGRRFEQAVGLPYSKKVLSEASAFIWKTFNQRAVGDRKPVNAVTLVVEDISGVAFTSANGIHLSAQYVASISGDVKKEVTGVLYHEATHVWQWNGQGKANGGLIEGIADYVRLKAGFAPGHWVKPGQGDRWDQGYDVTARFLDYCDSLKPGFVAQLNAKMKSGYTDDFFAQILGKNVQQLWRDYKSKFGA

SEQ ID NO: 10384 - protein, 209 aa, Secale cereale
AATAQAVTFDASNKASGTSGGRRFNQAVGLPYSKKVLSDASAFIWKTFNQRAAGDRKPVDAVTLVVEDISGVAFTSANGIHLSAQYVGGISGDVKKEVTGVLYHEATHVWQWNGQGRANGGLIEGIADYVRLKAGFAPGHWVRPGQGDRWDQGYDVTARFLDYCDSLKPGFVAQLNAKMKSGYTDDFFAQILGKNVQQLWKDYKAKFRG

SEQ ID NO: 10385 - protein, 225 aa, Pseudoroegneria spicata
  misc_feature (8)..(8): Xaa can be any naturally occurring amino acid
MKLQVATXAFFLLVTMAATARAVTFDASNTASGTAGGQRFDQAVGLAYSKQVLSDASTFIWNTFNQRAAADRKPVDAVTLVVEDIDGVAFTSGNGIHLSAKYVGGYSGDVKKEVTGVLYHEATHVWQWNGQGAANGGLIEGIADYVRLKAGLAPGHWRPQGSGDRWDEGYDITARFLDYCDSLKPGFVAQLNAKMKSGYSDDFFAQILGKNVQQLWQDYKAKFRG

SEQ ID NO: 10386 - protein, 225 aa, Hordeum vulgare
MKPQVATVAFLLLVTMAATARAVTFDASNTASGTAGGQRFDNAVGLAYSKQVLSDASTFIWNTFNQRAAADRKPVDAVTLVVEDIGGVAFASGNGIHLSAKYVGGYSGDVKKEVTGVLYHEATHVWQWNGRGTANGGLIEGIADYVRLKAGLAPGHWRPQGSGDRWDQGYDITARFLDYCDSLMPGFVAQLNAKMKSGYSDDFFAQILGKNVQQLWKDYKAKFGG

SEQ ID NO: 10387 - protein, 225 aa, Hordeum vulgare
MKPQVATVSFLLLVTMAATARAVTFDASNTASGTAGGQRFDNAVGLAYSKQVLSDASTFIWNTFNQRAAADRKPVDAVTLVVEDIGGVAFASGNGIHLSAKYVGGYSGDVKKEVTGVLYHEATHVWQWNGRGTANGGLIEGIADYVRLKAGLAPGHWRPQGSGDRWDQGYDITARFLDYCDSLMPGFVAQLNAKMKSGYSDDFFAQILGKNVQQLWKDYKAKFGG

SEQ ID NO: 10388 - protein, 227 aa, Pennisetum glaucum
MKLHAAAAVVSLLAVALAASTAGAVTFDATNTASSTPGGQRFDQAVGLDYAKRVLSDASTFIWNTFNQRAAADRKPVDKVTLVVENIDGVAFTSANGIHLSAKYVGGYSGDVKKEVTGVLYHEVTHVWQWNGQGRANGGLIEGIADYVRLKAGYAPGHWVKPGQGDRWDQGYDVTARFLDYCESLKPGFVAQLNAKMKDGYTDDFFAQILGKSVQQLWQDYKAKYGG

SEQ ID NO: 10389 - protein, 223 aa, Triticum aestivum
MKLHVAFFLLVAMAATARAVTFDASNTASGTTGGKRFDNAVGLAYSKQVLSDASTFIWSTFNQRAAADRKPVDAVTLVVEDIDGVAFTSGNGIHLSASYVGGYTSGDVKKEVTGVLYHEATHVWQWNGQGAANGGLIEGIADYVRLKAGLAPGHWRPRGSGSRWDEGYDITARFLDYCDSLKPGFVAQLNAKMKSGYSDDFFAQILGKNVQQLWQDYKAKFGG

SEQ ID NO: 10390 - protein, 223 aa, Triticum aestivum
MKLHVAFFLLVTMAATARAVTFDASNTASGTTGGKRFDNAVGLVYSKQVLSDASTFIWSTFNQRAAADRKPVDAVTLVVEDIDGVAFTSGNGIHLSASYVGGYTSGDVKKEVTGVLYHEATHVWQWNGQGAANGGLIEGIADYVRLKAGLAPGHWRPQGSGSRWDEGYDITARFLDYCDSLKPGFVAQLNAKMKSGYSDDFFAQILGKNVQQLWQDYKAKFGG

SEQ ID NO: 10391 - protein, 232 aa, Triticum aestivum
MKLHVAFFLLVAMAATARAVTFDASNTASGTTGGKRFDNAVGLAYSKQVLSDASTFIWSTFNQRAAADRKPVDAVTLVVEDIDGVAFTSANGIHLSASYVGGYTAGDVKKEVTGVLYHEATHVWQWNGQGAANGGLIEGIADYVRLKAGLAPGHWRPQGSGSRWDEGYDITARFLDYCDSLKPGFVAQLNAKMKSGYSDDFPDSREERAAAVAGLQSQVRRLNGLLVISLSP

SEQ ID NO: 10392 - protein, 225 aa, Sorghum bicolor
MNKLHVATVASLLALAAATAGAVTFDATNTASNTPGGQRFDQAVGVNYAKQVLSDASTFIWNTFNQRSPADRKPVDAITLVVEDIGGVAFTSANRIHLSTQYVGNYSGDVKTEVTGVLYHETTHVWQWDGQGKANGGLIEGIADYVRLKAGYAPSHWVKPGQGDRWDQGYDVTARFLDYCDSLKPGFVALLNAKMKGGYTDDFFAQILGKTVQQLWKDYKAKYGG

SEQ ID NO: 10393 - protein, 222 aa, Brachypodium distachyon
MKLQQVAALLLALAASASAVTFDASNTASSTAGGQRFNQAVGLDYSKQVLSDASTFIWTTFNQRSTANRKPVDAVTLVVENIDGVAFASNNRIHLSSKYVGGYSGNVKAEVTGVLYHEATHVWQWNGQGKANGGLIEGIADYVRLKAGFAPAHWRKAGEGDRWDQGYDVTARFLDYCDSLKPGFVAELNGKMKGGYTDDFFAQILGKSVQQLWKDYKAKYGG

SEQ ID NO: 10394 - protein, 228 aa, Zea mays
MNKRQVAAAVAALLALLAASSTAGAVTFDATNTASDTPGGQRFDQAVGLDYAKQVLADASTFIWNTFDQPSPADRKPVDAVTLVVEDIGGVAFTSANGIHLSAQYVGGYSGDVKTEVTGVLYHETTHVWQWDGQGQANGGLIEGIADYVRLKAGYAPGHWVQPGQGDRWDQGYDVTARFLDYCDSLKPGFVALLNAKMKDGYTDDFFAQILGKTVQQLWQDYKAKYGG

SEQ ID NO: 10395 - protein, 232 aa, Setaria italica
MKQPHVATVASLLALAAAATTAAAVTFDATNSASNTPGGQRFDQAVGLDYAKRVLSDASTFIWNTFNQPSPDDRKPVDKVTLVVEDIDGVAFTSANGIHLSAKYVGGYSGDVKKEVTGVLYHEVTHVWQWNGQGRANGGLIEGIADYVQLKAGYAPGSWVLPGQGRRWDQGYDVTARFLDYCDSLKPGFVAQLNAKMKDGYTDDFFAQILGKSVQQLWQDYKAASKEQRSPL

SEQ ID NO: 10396 - protein, 426 aa, Hordeum vulgare
MKLPLSAGSPDAAPELAKPSLPTTWLILHALFCATSMAVGFRFSRLVVFLLFLPTPPMNPSAHLVSLVTPPLMLASSNATATITTTTTTTTTVTTTTTVAETDAGANAHHHGPVFVGRHAIRVRKWPHPDPSELLKAHGILAAVQEAQRRSRSRGADPPRPVIAVTPTTTSALQVPSLISLAHTLRLVDGPLRWIVVEPGHRTDAVAAVLARSNLDFIHLVASDGASTARLRMHALREVRKEKMDGVVVFADENGILRTELFDEAQKVKSVGALPVGILGEDEGTKESFLQAPACDEAGKLVGYHVSDETLLPAARSDMLLSTRLEWAGFVLNARVLWDGAAERPEWVRDLDAVDGGAHLDSPLALVTDAGQVEPLAKCAQAALAWSLRSDALREVKFPHEWKFEAPLVSAASRQQSSVVNTEDGH

SEQ ID NO: 10397 - protein, 426 aa, Hordeum vulgare
MKLPLSAGSPDAAPELAKPSLPTTWLILHALFCATSMAVGFRFSRLVVFLLFLPTPPMNPSAHLVSLVTPPLMLASSNATATITTTTTTTTTVTTTTTVAETDAGANAHHHGPVFVGRHAIRVRKWPHPDPSELLKAHGILAAVQEAQRRSRSRGADPPRPVIAVTPTTTSALQVPSLITLAHTLRLVDGPLRWIVVEPGHRTDAVAAVLARSNLDFIHLVASDGASTARLRMHALREVRKEKMDGVVVFADENGILRTELFDEAQKVKSVGAVPVGILGEDEGTKESFLQAPACDEAGKLVGYHVSDETLLPAARSDMLLSTRLEWAGFVLNARVLWDGAAERPEWVRDLDAVDGGAHLDSPLALVTDAGQVEPLAKCAQAALAWSLRSDALREVKFPHEWKFEAPLVSAASRQQSSVVNTEDGH

SEQ ID NO: 10398 - protein, 715 aa, Hordeum vulgare
MAALAAAIALASLLLALAPVVGADTDAAGVAALGNLYTSWNSPAQLVGWSAAGGGDPCGAAWTGVSCSGSAITSINLSGMGLNGTLGYQLASLVALTTMDLSNNSLHDVIPYQLPPNLIHLNLARNNFSGDLPYSISNILSLGYLNVSHNSLFQEIGELFGGLNSLSVLDLSFNNLSGNLPVSFVSLSNLSSLYMQNNQLTGTVNVLSNLSLTTLNIANNNFSGSIPGELSSVPDLTAGGNSFINMPASPPPIIMPPSGSPLAQPDRPRVPITFPNGPEDEIPIDEGDKKQGRQTGLLVGLAVGSVAAASCILFALVFCLHNLHKRKDGGTSEPKDFVGALAVNIDRDSNNNIHQDSPVATSVLQRPIGTPERAYGINSSPAKKIKVPGAATSYTVASLQVATNSFCQDSLLGEGSLGRVYKADFPNGKVLAVKKIDSAALSLYEEDHFLEVVSNISRLRHPNIVSLTGYCADHGQRLLVYEHIGNGTLHDMLHFSDEASKNLTWNARVRIALGTARALEYLHEVCLPPVVHRNLKSSNILLDEECSPHLSDCGLAAFSPNPEREVSTEVLGSLGYSAPEFAMSGTYTVKSDVYSFGVVMLELLTGRKPLDRSRERSEQSLVGWATPQLHDIDALAKMVDPAMDGMYPAKSLSRFADIIALSVQPEPEFRPPISEVVQQLVRLMQRASMLRRQSGDDLGSSYRAPEREGGASDAL

SEQ ID NO: 10399 - protein, 134 aa, Triticum aestivum
MAGDGDEEPPATGGDKLILRGLQFHGFHGVKQEEKKLGQKFVVDVDAWMDLAAAGDSDDIAHTVSYTDIYRIAKGVVEGPSRNLLESVAQSIAGSTLLEFPQISAVRVKVGKPHVAVQGIVDYLGVEILRRRGA

SEQ ID NO: 10400 - protein, 133 aa, Hordeum vulgare
MAGDGEEPPAMGGDKLILRGLQFHGFHGVKQEEKKLGQKFVIDVDAWMDLATAGDSDDISHTVSYSDIYRIAKGVVEGPSHNLLESVAQSIANTTLLKFPPISAVRVKVGKPHVAVQGVVDYLGVEILRHRKA

SEQ ID NO: 10401 - protein, 136 aa, Hordeum vulgare
MAGDGEEEPPATGGGGDKLVLRGLQFHGFHGVKQEEKKLGQKFVVDIDAWTDLAAAGDSDDISHTVSYTDIYRIAKGVVEGPSRNLLESVAQSIAASTLLEFPRISAVRVKVGKPHVAVQGVVDYLGVEILRRRQA

SEQ ID NO: 10402 - protein, 137 aa, Secale cereale
MAGDREEEPPRTGKGGGDKLILRGLQFHGFHGVKQEEKKLGQKFVIDVDAWMDLAAAGDSDDISHTVSYSDIYRIAKGVVEGPSHNLLESVAQSIASATLLKFPQISAVRVKVGKPHVAVQGVVDYLGVEILRHRKA

SEQ ID NO: 10403 - protein, 125 aa, Triticum aestivum
MAGGGDKLILRGLQFHGFHGVKQEEKKLGQKFVIDVDAWMDLAAAGDSDDISHTVSYSDIYRIAKGVVEGPSRNLLESVAQSIANTTLLKFPQISAVRVKVGKPHVAVQGVVDYLGVEILRHRNA

SEQ ID NO: 10404 - protein, 137 aa, Avena sativa
MAGDGKEEPKAMGTGGGDKLILRGMQFHGFHGVKQEEKTLGQKFVIDVDAWMDLAAAGDSDDISHTISYTEIYRIAKGIVEGPSHNLLESVAQSIANSTLLQFPQISSVRVKVEKPHVAVQGVVDYLGVEILRCRKA

SEQ ID NO: 10405 - protein, 137 aa, Avena sativa
MAGAGEEEPKEMGTGGGDKLILRGMQFHGFHGVKQEEKKLGQKFVIDVDAWMDLAAAGDSDDISHTISYTDIYRIAKGIVEGPPHNLLESVAQSIANSTLLKFPQISSVRVKVEKPHVAVQGVVDYLGVEILRCRKA

SEQ ID NO: 10406 - protein, 134 aa, Brachypodium distachyon
MAEEEAPAAGKLGGDKLVLRGMQFHGFHGVKQEEKKLGQKFVVDVDAWTDLAAAGDSDDISDTVSYTDIYRIAKGVVEGPPHNLLESVAQSIASSTLLKFPQISAVRVKVGKPHVAVQGVVDYLGVEILRYRKA

SEQ ID NO: 10407 - protein, 302 aa, Triticum aestivum
MSGGTAASGSLRTALSYCVQQVRSYDYHNYLCLLHLPPAMRKAAFTFRAFNVETAKAMDVVSDPRKGLMRLLWWKDVVDKVCAGKKVEHPVALALSSVLSEHKVSKHWLKRSLEARINDGNRDDDAIPENVPELERYAEDTQSTILYMTLQAGGIQSTVADHAASHIGKASGLLLLLKALPHHVSKQGKIPYIPASVAEECGLLAREGGRTEVRMGDALPDAVFKVASVAEAHLQKARELATSVPAEAVPVLLPAVPAQVLLDSLRRREFNVFDSRLSSGVHGISPLWYQLKLNWHAWRNKY

SEQ ID NO: 10408 - protein, 302 aa, Triticum aestivum
MSRGNVASGGLRTALSYCVQQVRSYDYHNYLCLLHLPPAMRRAAFTFRAFNVETAKAMDVVSDPRKGLMRLLWWKDVVDKVCAGKTVEHPVALALSSVLSEHKVSKHWLKRSLEARINDGNREEDAIPENVPELERYAEDTQSTILYMTLQAGGIQSTVADHAASHIGKASGLLLLLKALPHHVSKQGKIPYIPASVAEECGLLAREGGRTEVRMGDALPDAVFKVASVAEAHLQKARELAASVPAEALPVLLPAVPAQVLLDSLRRREFNVFDSRLSSGVHGISPLWYQLKLNWHAWRNKY

SEQ ID NO: 10409 - protein, 302 aa, Hordeum vulgare
MSGGTAVSASLRTALSYCVQQVRSYDYHNYLCLLHLPPAMRKAAFTFRAFNVETAKAMDVVSDPRKGLMRLLWWKDVVDKVYANKTVEHPVALALSSLLSEQKVSKHWLKRSLEARINDGNRDDDAIPENIPELERYAEDTQSTILYMTLQAGGIQSTIADHAASHIGKASGLLLLLKALPHHVSKQGKIPYIPASVAEECGLLAREGGRTEVRMGDALPDAVFKVASVAEAHLQKARELAASVPAEAVPVLLPAVPAQVLLDSLRRREFNVFDSRLSSGVHGISPLWYQLKLNWHAWRNKY

SEQ ID NO: 10410 - protein, 297 aa, Hordeum vulgare
AASASLRTALSYCVQQVRSYDYHNYLCLLHLPPAMRKAAFTFRAFNVETAKAMDVVSDPRKGLMRLLWWKDVVDKVYANKTVEHPVALALSSLLSEQKVSKHWLKRSLEARINDGNRDDDAIPENIPELERYAEDTQSTILYMTLQAGGIQSTIADHAASHIGKASGLLLLLKALPHHVSKQGKIPYIPASVAEECGLLAREGGRTEVRMGDALPDAVFKVASVAEAHLQKARELAASVPAEAVPVLLPAVPAQVLLDSLRRREFNVFDSRLSSGVHGISPLWYQLKLNWHAWRNKY

SEQ ID NO: 10411 - protein, 302 aa, Leymus cinereus x Leymus triticoides
MSGGTAASGSLRTALSYCVQQVRSYDYHNYLCLLHLPPAMRKAAFTFRAFNVETAKAMDVVSDPRKGLVRLLWWKDVVDKIYANNTVEHPVALALSSVLSEQKVSKHWLKRSLEARINDGNRDEDAIPENIPELERYAEDTQSTILYMTLQAGGIQSTVADHAASHIGKASGLLLLLKALPHHVSKHGKIPYILASVAEECGLLAREGGRSEVRMGDALPDAVFKVASVAEADLQKARELATSVPAEALPVLLPALPAQVLLDSLRRREFNVFDSRLSSGVHGISPLWYQLKLNWHAWRNKY

SEQ ID NO: 10412 - protein, 302 aa, Brachypodium distachyon
MSGGPAASGGLRAALSYCVQQVRSYDYHNYLCLLHLPPSMRRAAFTFRAFNVETAKAMDVVSDPRKGLMRLLWWKDVIDKIYANKLVEHPVALALSSVLSEQKISKHWLKRSLEARINDGNRDEYAIPETIAELERYSEDTQSTILYMTLQAGGIQSTIADHAASHIGKASGLLLLLKALPHHVNKQGKIPYIPASVAEECGLLRQEGDRSEVRMGDALPDAVFKVASVAEAHLQKARELASSLPAQAAPVLLPAVPTQVLLDSLRCREFNVFDSRLSKGVHGISPLWYQLKLSWHAWRNKY

SEQ ID NO: 10413 - protein, 302 aa, Setaria italica
MSRAPAASSSLQAALSYCVRQVRSYDYHNYLCLLHLPPAMRKAAFTFRAFNVETAKAMDVVSDPKTGLMRLLWWKDVIDKVFANKLVEHPVAQALSSVVSDHKVSKHWLKRSVEARINDANRDEGAIPETSAELERYAEDTQSTILYMTLQAGGIQSTAADHAASHIGKASGLLLLLKALPHHVNKQGVIPYIPANVAEECGLLTREGGRSEVRMDERLPDAVFKVASVAEAHLLKARELASSVPREAIPVLLPALPAQVLLDSLRRCEFNVFDSRVSRGVHGVSPLWYQLKLNWYAWRNKY

SEQ ID NO: 10414 - protein, 302 aa, Oryza sativa
MGSTAAAGGNLRTALSYCVQQVRNYDYHHYLCLLHLPPAMRKAAFAFRAFNIETAKAMDVVSDPKTGLMRLLWWKDVVDKVFANKLVEHPVAQVLSSVVSEHKISKHWLKRSVEARINDANRDDYAIPETISELERYAEDTQSTILYMTLQAGGIQSTIADHAASHIGKASGLLLLLKALPHHVSKQGRIPYIPASIAEECGLLTREGGRSEVRMGDELPDAVFKVASVADAHLQKARELASSVPAEAIPVLLPGVPAQVLLDSLRRREFNVFDSRLSRGVHGISPLWYQIKLIWHSVRKKY

SEQ ID NO: 10415 - protein, 302 aa, Sorghum bicolor
MSGTPAASSSLQAALSYCVRQVRAYDYHHYLCLLHLPPAMRKAAFTFRAFNVETAKAMDVVSDPRTGLMRLLWWKDAVDKVFANKLVEHPVAQALSSVVADHKVSKHWLKRSVEARINDANHDEGTIPETSTELERYAEDTQSTILYMTLQAGGIQSTVADHAASHIGKASGLLLLLKALPHHVNKQGTVPYIPASVAEECGLLTREGGRSEVRMDERLPDAVFKVASVAEAHLHKARELASSVPKKAIPVLLPAVPAQVLLDTLRRCEFNVFDSRLSRGVHGVSPLWYQLKLNWNAWRNKY

SEQ ID NO: 10416 - protein, 302 aa, Panicum virgatum
MSATPAASASLRAALSYCVRQVRSYDYHHYLCLLHLPPAVRKAAFTFRAFNVETAKAMDVVSDPKTGLMRLLWWKDVIDKVFANKLVEHPVAQALSSVVSDHKVSKHWLKRSVDARINDANRDEGAIPETSAELERYAEDTQSTILYMTLQAGGIQSTVADHAASHIGKASGLLLLLKALPHHVNKQGVIPYIPANIAKECGLLTREGGRSEVRMDERLPDAVFKVASVAEAHLHKARELASSVPREAIPVLLPALPAQVLLDSLRRCEFNVFDSRVSRGVHGVSPLWYQLKLNWYSWRNKY

SEQ ID NO: 10417 - protein, 147 aa, Panicum virgatum
MSATPAASASLRAALSYCVRQVRSYDYHHYLCLLHLPPAVRKAAFTFRAFNVETAKAMDVVSDPKTGLMRLLWWKDVIDKVFANKLVEHPVAQALSSVVSDHKVSKHWLKRSVDARINDATVMRVPFLRQVLSWRGMLKTPSPPSFT

SEQ ID NO: 10418 - protein, 147 aa, Panicum virgatum
MSATPAASSSLQAALSYCVKQVRSYDYHHYLCLLHLPPAMRKAAFTFRAFNVETAKAMDVVSDPKTGLMRLLWWKEVIDKVFANKLVEHPVAQALSSVISEHKVSKHWLKRSVEARINDATVMRVPFLRQVLSWRGMLKTPSPPSFT

SEQ ID NO: 10419 - protein, 302 aa, Panicum virgatum
MSATPAASSSLQAALSYCVKQVRSYDYHHYLCLLHLPPAMRKAAFTFRAFNVETAKAMDVVSDPKTGLMRLLWWKEVIDKVFANKLVEHPVAQALSSVISEHKVSKHWLKRSVEARINDANGDEGAIPETSAELERYAEDTQSTILYMTLQAGGIQSTVADHAASHIGKASGLLLLLKALPHHVNKQGVIPYIPANIAEECGLLTRDGGRSEVRMDERLPDAVFKVASVAEAHLHRARDLASSVPREAIPVLLPALPAQVLLDSLRRCEFNVFDSRVSRGVHGVSPLWYQLKLNWYAWRNKY

SEQ ID NO: 10420 - protein, 1224 aa, Panicum virgatum
MAAADGRSSDGGGGRIHRLEVENFKSYKGTQTIGPFFDFTAIIGPNGAGKSNLMDAISFVLGMRTAQLRGAQLKDLIYALDDRDKEAKGRRASVGLVYRQPNQEELHFTRTITGAGGSEYRIDGRLVTWDEYNAKLRSLGILVKARNFLVFQGDVESIASKNPKELTALLEQISGSDELRREYDELEEQKARAEENSALVYQEKRTIVMERKQKKAQKEEAEKHLRLQQDLKRLKTEHSLWQLYTIEKDREKLEAELAEDRESLQQVQEENQSAENELTAKKKEQSAFLKKMTLCEKSIAKKKLELDKKLPELLKLKEQISRLKSKIKSCKKEIDKKKDDNKKHLEEMRRLQSALVDVTKAIEELNEQGQDKSGKLQLADDQLQEYHRIKEDAGMKTAKLRDEKEVIDKKLNADVEAKKNLEENMQQLRSREDEISSQETELQTRLDKILHSIPKHENELTHLREEHTRIAKERQSSGSRYQTLKQRVDEIDTQLRELKADKHESERDARLKETVGSLKRLFPGVHGRMHELCRPSQKKYNLAVTVAMGKFMDAVVVEDENTGKECIKYLKEQRLPPQTFIPLQSVRVKPIVEKLRTLGGSAQLVFDVIQFDRALEKAVLYAVGNTLVCDKLDEAKTLSWSGERYKVVTVDGILLTKSGTMTGGISGGMEARSNKWDDSRIESLKKKKNHLESEMSELGSPRELQRKELAISEKITGLEKKLHYLNVEQNNLRAKLLKLASERSNIEEEINRLEPGKEELETRLAEKEAEVRKLEKKINEIVDKVYRDFSISVGVKNIREYEERQLKDAQALQERKLSLSNQMSKLKYQLEYEQKRDMQAPIMKLRETFESLEKELKGLQERESGAKAEAEEISTQMDELKAEAEDWKSKSDECEKVIDELKEQNGNVTSTLAKLDRQVKSKEGQVVQLISRQREIHEKCELEQLKLPTVNDPMDTGSSSEEPVFDYSQLKEIYLQDMRPSERDKHEAEFKQRTGALLADIERTAPNLKALDQYDALQRKEKEVTEKFEAARKEEREISDKYNSVKQRRYELFMKAFDHISKGIDRIYKQLTKSHTHPLGGTAYLNLENEDEPFLHGIKYTAMPPTKRFRDMEQLSGGEKTVAALALLFAIHSFRPSPFFILDEVDAALDNLNVAKVAGFIRSKSCERVTGEQGGGGESGFQSIVISLKDSFYDKAEALVGVYRDSERSCSRTLTFDLTKYREA

SEQ ID NO: 10421 - protein, 1233 aa, Setaria italica
MAAAAAEDGRTSDIRSRGDGGGGRIHRLEVENFKSYKGTQTIGPFFDFTAIIGPNGAGKSNLMDAISFVLGVRSAHLRGAQLKDLIYALDDRDKEAKGRRASVRLVYRQPNQEELHFTRTITGAGGSEYRIDGRLVSWDDYNAKLRSLGILVKARNFLVFQGDVESIASKNPKELTALLEQISGSDELRREYDELEEQKARAEENSALVYQEKRTIVMERKQKKAQKEEAENHLRHQQDLKLLKTEHSLWQLYTIEKDREKMEAELAEDRESLQQVQEENQSAENELTAKKKEQSAFLKKMTLCEKSIAKKKLELDKKQPELLKLKEQISRLKSKIKSCKKEIDKKKDDSKKHLEEMRRLESALVDVRKALEELNEKGQDKSGKLQLADDQLQEYHRIKEDAGMKTAKLRDEKEVIDKKLNAYVEAKKNLEENMQQLHSREEELSSQERELQTRINKILHSIPKHENELAQLREEHNRIAKERQSSGSRYQTLKQRVDEIDTQLRELKADKHESERDARLKETVGSLKRLFPGVHGRMHELCRPSQKKYNLAVTVAMGKFMDAVVVEDENTGKECIKYLKEQRLPPQTFIPLQSVRVKPIIEKLRTLGGSAQLVFDVIQFDRALEKAVLYAVGNTLVCDKLDEAKTLSWSGERYKVVTVDGILLTKSGTMTGGISGGMEARSNKWDDSRIESLKKKKNQLESEMSELGSPRELQRKELAISEKITGLEKKLQYLNVEHSNLTAKLLKVASERNNIEEEINRLEPEKEELEIRLAEKEAEVTKLEKKINEIVDKVYRDFSISVGVKNIREYEERQLKDAQALQERKLTLNTQMSKLKYQLEYEQKRDMQAPIVKLRETYESLEKELKGLQERESGAKVEAEEILTQMDELKAEAEDWKSKSDECEKVIDELKEQNGSIASTLAKLDRQVKSKEGQLLQLMSRQRDIYEKCELEQLKLPTVNDPMDTGPSSQEPVLDYSQLSEIYLQDMRPSERDKHEAVFKQKTGALLAEIERTAPNLKALDQYDALQRKEKEITEKFEATRKEEREISDKYNSIKQRRYELFMEAFDHISKGIDKIYKQLTKSHTHPLGGTAYLNLENEDEPFLHGIKYTAMPPTKRFRDMEQLSGGEKTVAALALLFAIHSFRPSPFFILDEVDAALDNLNVAKVAGFIRSKSCERVADEQGRNGECGFQSIVISLKDSFYDKAEALVGVYRDSERSCSRTLTFDLTKYREA

SEQ ID NO: 10422 - DNA, 2000 bp, Wheat SPA Promoter
ttttctcttgcgagagccgctcacctcaaggccccccgccattcctgctgtgaactatagccagcggctggggatgatacaagcaggggcaaccaacgaccaccggagttgccacggttgtcactgatgttgcggtggcgccaccatgaagaccatgtccatgcggtggttggtgcagtttccagcggtgctacaaccgcggaacactaatgctgcaaccggtagcaggagctgttgcgaccgacgacgaaatttgctgccttgaggctgatggtaatggacaagacgagggcggacgccttggtgctacaaccagcatccggtgttgccggaacgacaaccgccatttgctgcaaccggcaatcatgcaacacagagaggaagataccgcgtgctgggatcggccgtcaccctgggcgcgacaaaaagctgcaaccattcgttggtaaagcttcaacctcctgatgaatttcctggaaccagtattcaattttgcttgaactggataattttttgctacaatcgatcaacgagagttcttgctggtaagttgtttttgctagaaccggtgttcaattttgctagaactatattttgctacaatcgatcaccccgagagttcttcttgatgagttgttttgctcgaaccagtattcaattctgctggaactgagtaattttttgcttcaaccaacaaatggtggatttgctgctttccaagttttttgttgggcacgactgtgcaagtcaacgatcgcggcggcgccgatggtgctccaaccatggtgaacgcgcgatggaaccagccgggccggagctgcaatggcctggttcccgagctatggacgcggcgtgcggtgactgcaagcttcagcagaagggtggcagggggctggatgatggtgctgcaaccagtagcggtgcaaggggacggggtgctgccgcccctcgatggagcgcacatgcatgggaccgagagcagagatgctcacggggaacaggaaggaggggatttcctgctcacgttgaccaaagcgagaggaaggagatgattcggtgaccgactacaaatcatcatatcaaacaattgggggccgaccggccaaaacgttcggtcggcgtgctagtggctaataatggcctaccggtatggaccacgttagtcaaatggtaagcgacgcatgtatataaggtatattaatgcgaccaactcgcaaggtccgtcacctatattcggagaacatatttctgtaatatataaatttaataggtaaagtcacatttatcattctcaaaagagggtggcccgtgtgaggaactcgtcctgagcaaagacgaggaggtttccactcaaccgttgtcactctagctatagtgtatattagaagttaagtgtttccgttaccttttcatatacaacaacaatttaaagttagaaaccctgtaaatcacatggaagcgtatggatcgcaacgagtcaaaataaacatggcgcattagtgacacgtattttaaactttctgttaacactttttgttctttcattaaaggatatttgtttgcattagcgttgtcatgctagacgagcacatacattacaacattattatgtgtttgttgtggtttctagagacaagacatgaacacctaaataaagaggacatggacgaaaaggttaaccgtaatagctcatgcaagatgacaagcaaaacatttcattgtatgaggttccgtggatcacacttctctatgtactctcagaaacgaaaacacttgtctagacgatggtagaccgtcggaataggtgaacatcttttgtacaacagaaagtatgactaacgtggcgccgcggccgaaactgcattatcagttcagctgaatttgtactgtatgtcatatctatctcgagtattcaagacagaaaaaccttgtgcagtagtagtactactgaaataaaatagacatgagaggatcgcaccctcaacccatctcattcagca

SEQ ID NO: 10423 - DNA, 1919 bp, Wheat LMW Longer Promoter
  misc_feature (1306)..(1316): n is a, c, g, or t
  misc_feature (1649)..(1649): n is a, c, g, or t
tatcatgatgacatttctatgtgctaaagattcttctacaaagccggttcaaatacaaaacaaatatgccaaaaaactacttaaattaccagtagcgagtgtacaaaagttagcagcagcgcctcaatagcagtagagcgtccggccaaagagcgctagcgctactagcggtagcgagcttctcataaccgcgctgctgctacacttgtgtagcagtagcgcgggtgctcacgcgttactgctatgagttagctgtagcgccgtattagtagcgcgggtacccgcactactgatacatctaaaacccgcgctgctgctagccttttccctagtagtgctagtcgatgtatctccccacaacctcacctctacaccggactacaaggaagtcttctgacggcgggaattgccgaagcacgcttgaccccacttgttcctcgccggacaaaagacatctagcgcggcataattcaaacgccacgctggaaccaatagtcgtagcggggcggtcaggaactgcgtcatctcgcttattaggcatgcttttcatatttttacttgcgaccctacagcacggttccgtgtcaatatcatagacttctagttgtggagttttgttttttcgtcgtcgacatgagaaatatatggtccacctgcttagcgcgcatagggggaaatttgatgattattggaacttttgaagtgaaattctcagaaagcacatagttatattcagctactaaagccacaaatgtacattactgtcaggcttcccagctgaattctgatgcctgaccctcctaatccgtgcagctagcatggagatgggtctgcctctcggatttatgtgcattgaatcgttggaagagacagacgaaacaaatcgataccttgtgttgatggggaggtcggagtggctgccgtcgacgtacggcccacaatcgacggaggagcttcaaaagtgaccttttttgtcgagcggtggtggtggtggtggggggccggatgttgagggtgggagggaggctgacgtctccgctgccgcggaggtacgtggaggggccgcgagcggtgggcgtccgggagaggctgcgacggcgagcggtccggccggcgaggaggacgaggaagggagggacgcagatccgcggagtgtgggctgggcttgtgtcgttggggcctacgagaactatagcccaaatcgaattggtgccctaacacacggcacttatgttgggcctaatctctcgctccaggctgggggcctctgttccagccccatctatcatttccccctagcgtcatnnnnnnnnnnnaaaaaaatccccctagcataaaaaaactatcatttcccccaaaaaaacccttcacaaatagatgaaactgatgatttatctaaaaaaataggcgaaactgatgatgacgtgtcaagagttaggaccggatatatgctagtaggagtagcttgtaagcaattaccatcctttacatgtaaagggaattcgatgagtcatgtcatgctctataggcgtcggttcatctaatcattttagaggaaaaatacaaagttagttctacacttagtcctacacaagttttgcctttcttgtttatggatgacagcctatacaaggttccaaactcggttnacaaggttccaaactcggttgcaaaagtgatactatccagataagtgtgtgacatgtaaagtgaataaggtgagtcatatataccaaacatcaaggtttctgtactttatgtgtgatcatatgcacaactaaaaagcaactttgatgatcaatccaaaagtacgcgtgtagctagtgcaacctaacacattgtaccaaaaatcattttagatgcatccaaacagaattattaaagctaatgcaaagaagaaaagaggtggtgcccgggct

SEQ ID NO: 10424 - DNA, 326 bp, Wheat LMW Promoter
  misc_feature (56)..(56): n is a, c, g, or t
agttttgcctttcttgtttatggatgacagcctatacaaggttccaaactcggttnacaaggttccaaactcggttgcaaaagtgatactatccagataagtgtgtgacatgtaaagtgaataaggtgagtcatatataccaaacatcaaggtttctgtactttatgtgtgatcatatgcacaactaaaaagcaactttgatgatcaatccaaaagtacgcgtgtagctagtgcaacctaacacattgtaccaaaaatcattttagatgcatccaaacagaattattaaagctaatgcaaagaagaaaagaggtggtgcccgggct

SEQ ID NO: 10425 - DNA, 2000 bp, Wheat HMW glutenin-1 longer Promoter
cctaccattagaagaacgtccggcaaagagatgcactgcaacatatgaccaaaacgtcatccatgatcgagtacaatttcttagtgcctttttcatcaaagttatatttgaaacattttagaaaatttgtcttaaattttttcccatggcgtttcgatcaaaaaaatgccttaaaacctacctatataaaggcaataagggaaaacacttcaggataccttcgaatctaaggtgtctttctttagatggtatgctaaactgttcttcatggcgcctcaaatcatcattctgcaagtaaagactaaaaataacgctaaatatggagttaaaggtttacaaacgacgagcggaaaaggagtcttatataattccagtagcatttattccattttgcttcacatagaaaatgtagctgaggtggtcgatgtttattttgactcgcgtgaggtcgccggttcgatctcagaagcaacgctggaatatcccatatagatttatttttcaggctgagtgatgctcgggtacctccagcgtatgggctgaaattcgccccccctgcaaatcatgggccctgtgacgttcgcacgggttgcacatgccttggcccgggcctactaggagtgtacctggattatgttggacgacgggagatgaaagggatgtattaattaacaaagataatgaagcttaattttcttatatgttgttaatattgacaagaaacaagctgctaactcaaagttacggttacatagtcgcaaccttttatatctaaataatatctctctctcaacatgcaaacatgccacctcagcatgtagcatgcatggaaattgtccacttcaacatgcaaccatgcatcaaaatttccattttactaggctatttatttgataaaatttcacaaatatacaataatcaaacacaatagatcatatgtgttttcagttttggttctcacattattactccaaatataaatgtttcgtataaccaaatttcattcaaatatactgcaaaacatttccgtgaaaacatgtggggtacatctagttataaggaaatattagtgatgtcctgcaagtgataaggccaaggagagaagaagtgcaccatctacagaggccagggaaagacaatggacatgcagagaggcgggggcggggaagaaacacatggagatcatagaagaacataagaggttaaacataggaggaggatataatggacaattaaatccacattacctgaactcatttgggaagtggaaaaatcccctattctggtgtaaatcaaactaattgacgcgagttttctctgaagattctatgttaattttagacatgaatgaccaaaggtttcagttagttgagttttgtcatcgaaaggtgtttacataagtccaaaaattctaccagcttttggtacggcgcgtcatagaacagataaatgttgtgagtcattggatagatattatgagtcatagcatggatttgtgttgcctggaaatctaactatgacaagaaacaaaacataaatgggcttttgaaagatgatttatcaacttaccttatccatgcaagctaccttccactagtcgacatgcttagaagcttttagtgaccgcagatttgcaaaagcaatggctaacagacacccaaaccccaagaagcataaccacttctcttagataaaaatagcagatcgatatacaaacgtctacacttctgcaaacaatacccagaagccagaattaggattgaaccgattacgtggctttagcagaccgtccaaaaatctgttttgcaaagctccaattgctccttgcttatccagcttcttttgtgttggcaattgttcttttccaaccgactttattcttttcacatttcttcttaggctgaactaacctcgtcgtgcacacaaccattgtcctgaaccttcaccacgtccctataaaagcccaaccaatctccacaatttcatcatcacccacaaca

SEQ ID NO: 10426 - DNA, 425 bp, Wheat HMW glutenin-1 Promoter
catgcaagctaccttccactagtcgacatgcttagaagcttttagtgaccgcagatttgcaaaagcaatggctaacagacacccaaaccccaagaagcataaccacttctcttagataaaaatagcagatcgatatacaaacgtctacacttctgcaaacaatacccagaagccagaattaggattgaaccgattacgtggctttagcagaccgtccaaaaatctgttttgcaaagctccaattgctccttgcttatccagcttcttttgtgttggcaattgttcttttccaaccgactttattcttttcacatttcttcttaggctgaactaacctcgtcgtgcacacaaccattgtcctgaaccttcaccacgtccctataaaagcccaaccaatctccacaatttcatcatcacccacaaca

SEQ ID NO: 10427 - DNA, 595 bp, wheat alpha gliadin (B genome) Promoter
tcaagcttgtctagttacagtaacaacttgtggaacattacaaaatttatgtttgctagtaacttctagaacactacaacacttgacatgtataaggaatttgatgagtcatggcctactaaagcaagttatattactactcttatctatcttaacaggtcacacaagattacaaactaagttctgtatcagccatgcttatctagtttatgcataacaatttgcagaacattacaaacttagtttcggaaaaataggcaatctagattagtgtttgagctataaagtgaataagatgagtcatgcgtgttatcacacctctttggtggtggaatgatagtgcaacaacatgaaacttcagtgactagtccaagaatacacatgtaagtagtgccaccaaacacaacataccaaattatgattttgggaagcatccaagcactttccagacaagaaaatgccaattgtgaaagagatcataccatgggaactataaaaagccttgtagcatgatcatcatccttcctcacccatcattctcataagtagagcgcatcattcaagccaagcaagcagtggtcaatacaaatccacc

SEQ ID NO: 10428 - DNA, 1238 bp, wheat gamma gliadin Promoter
  misc_feature (1231)..(1231): n is a, c, g, or t
atacttatatagggtagcgatattcacttgggaggtcggggttgtgctcggggaagcaggggcttgccggacgcaaggctcggacggcctccacgcctctgttccgtgaacagaggagatgggatcctccaagtgggcggggccacaatagtttatagtaggcccatgtgcacagcaggtcttccatattttccctttttatctcctgtaatatttccaccactctattgcatttagtttatgcagcaaacgacttttgctataactgaaacttggcacataaatcaagcacacaattttggggtggcacaaaaagtttggggccaaattgaaatcacttaaattataattgcatttaaaagagctaaaagggtgtcgttggtccacagtttaatattcataggcattttaaaagtttccagaaaaaactttgctaatgtatgacagttatgtagtgaatattttcaacctaaggaacatttttaatttattttttataaaattataattcgacttggcattcgaatttggatttgagttttggtttgaaacggaaagaggattagtaaaatgattatgatgacatagcatcattaggcatgagattactgtagcatgacatcgggggtgttacacttgtacaatattcctacccttgacataaaaggagaatttgatgagtcatgtattgataacgtatacaacattactacccttgacataaaaggagaatttgatgagtcatgcattgataacatgtacaagattactatcagcttgttcatcttaccatcatattatacaacactacaagttagttttagaaagaacaagagtccacaacaaatatcagaatacttgcctgatctatcttaacaacatgcacaaggacacaaatttagtcccccgcaagctatgaagatttggtttatgtctaacaacttgtacagatccaaaaggaatgcaatccagataattgtttgacatgtaaagtgaataagatgagtcaatgccaattatcagtattcctcactcttagatgatatgtacaataaaaagacaactttgatgatcactctgaaattacgtttgtatgtagtgccaccaaacacaacataccaaataattagtttgataagcatcaaatcacttttaaaaaagaaagcaataatgaaaagaaacctaaccatggtagctataaaaaggcctacaatatgtagactccataccnactccat

SEQ ID NO: 10429 - DNA, 2162 bp, wheat TdPR60 longer Promoter
agaagaagaaggagcaccaatacaatggagtttcacccggcttcacagccctgttacttttcccagagccccaaaaactctcctcaacaaatacactcgtggtcatggctttgtaggggcacaacaacgcagcgcccacgtttccttgtgcgcatgtacgcacgccgcctagctagcaaccctgcatgcaatcccatcagcccggccatgcgcactacatgcgcgctacgcacacgacgcggccatctccaccggtcactgctaacaatcatctaactaactcacacgcatcaagcaaacttggccggcacacttgccaacgccctgctctacgtgccagactcgagagtatacacgctacacacacatgcgccacgcttctgcgtcccgtacgtcccgcccgtcccgcatgtcatcgacgcgcccgtcaagcccgacgagcccgacggcaccagtgtgtcccgcctgtcccacgcgcacccgacgcgcccgacgagcccgatcacacatgtcgtggcttattccaaaacacaccccttaagccacggcctagaggagtccgtcatcgtcgacgttggcgccggctaagagtgcatgctccgccgccggtcctttccgcagctgcgggcactcgcgccggaagtgcccgtgctccccgtacttgtagcagcgcctgcgcctgtcgccgccgctccccgacgccacgctgcgcccgtcgtcgtcgtcccgagcaccgccgtgtcgacgctcccatgctgcccactgcgccaccgtcatgagcagctgctcacctccgcgctcgccgccgtcttgtccacagcgccgaacccgctcgtcgaacgcacgcagccgcccgagcgcttcgtcgaacgccatcgtcgtcacgtcgtggaactgctcgataccggcgacgacggggaagaggcgatccgacaccgtatcccagcaacttcttgacaagtgccgtgtcgcccagtgtctccccgaggttggcatacctcgccgccatcgccgcgagcctcccgccgtacacgtcgagctcctcgccgtccaccatcttcatccggtcgaatttgccatgcagcgtccccggcctcgctgcgcgtacccgatcagcgcggacgaacctcaccttcagggagtcccatacctccctgacggtgagcttcgtcgataccagcagcagcacatcctccggcaacgccccgagaagcaacgtgcgcaccatcttgtccttccgcgcgttcaccaccgcgtcgcccggcgccaccgcctcccatacggtgtggacgtcgaggatcgcctacgccttgatggcccagaccgtgtagttgtccgcggtcagcaaaggcatcgccatcgtcgccgattccgcccgcgccgccgccgtgtgggacgggcgccatggtcgccggtgatcgcccgaaccaaagctctgtatatcaattgttggaagcgctctctcacactgatggatggagatagaagaagaaggagcacacagtacaatggagtttcacccggcttcacagccctgttacttttcccagagccccaaaaactctcctcaacaaatacactcgtggtcatggctttgtagtggcacaacaacacaacgcccacgtttccttgtgcgcacgtatgcacaccgcctagctagctaccctgcatgcaatccatcagcccggccatgcgcactacatgcgcgctatgcgcatgacgcggccatctccaccggtcactgctaacaatcagctaactaactcacacgcatcaagcaaacttggccggcacacttgccaacgccctgctctatgtgctagactcgagtgtatacacgctacacacacatatgccacgcttctgcgtcccgcatgtcccgcacgtcaccgacgcgcctgacaagcccgacgagcccgacggcaccagtgtgtgccgcccgttccgcgtgcacccgatgcgctcgacgagcccgatcacacacgccgtggcttattccaacacctagatgtataattaatgtatacattaattgtctgacacggtgctatatcttcatgatatacaactggtgtatgcgtctgtatcatcatctcaaagaaggctatatataccaagacatagctagcgaagtcatgtatcccacacattcacagaagcca

SEQ ID NO: 10430 - DNA, 2147 bp, wheat TdPR60 Promoter
accaatacaatggagtttcacccggcttcacagccctgttacttttcccagagccccaaaaactctcctcaacaaatacactcgtggtcatggctttgtaggggcacaacaacgcagcgcccacgtttccttgtgcgcatgtacgcacgccgcctagctagcaaccctgcatgcaatcccatcagcccggccatgcgcactacatgcgcgctacgcacacgacgcggccatctccaccggtcactgctaacaatcatctaactaactcacacgcatcaagcaaacttggccggcacacttgccaacgccctgctctacgtgccagactcgagagtatacacgctacacacacatgcgccacgcttctgcgtcccgtacgtcccgcccgtcccgcatgtcatcgacgcgcccgtcaagcccgacgagcccgacggcaccagtgtgtcccgcctgtcccacgcgcacccgacgcgcccgacgagcccgatcacacatgtcgtggcttattccaaaacacaccccttaagccacggcctagaggagtccgtcatcgtcgacgttggcgccggctaagagtgcatgctccgccgccggtcctttccgcagctgcgggcactcgcgccggaagtgcccgtgctccccgtacttgtagcagcgcctgcgcctgtcgccgccgctccccgacgccacgctgcgcccgtcgtcgtcgtcccgagcaccgccgtgtcgacgctcccatgctgcccactgcgccaccgtcatgagcagctgctcacctccgcgctcgccgccgtcttgtccacagcgccgaacccgctcgtcgaacgcacgcagccgcccgagcgcttcgtcgaacgccatcgtcgtcacgtcgtggaactgctcgataccggcgacgacggggaagaggcgatccgacaccgtatcccagcaacttcttgacaagtgccgtgtcgcccagtgtctccccgaggttggcatacctcgccgccatcgccgcgagcctcccgccgtacacgtcgagctcctcgccgtccaccatcttcatccggtcgaatttgccatgcagcgtccccggcctcgctgcgcgtacccgatcagcgcggacgaacctcaccttcagggagtcccatacctccctgacggtgagcttcgtcgataccagcagcagcacatcctccggcaacgccccgagaagcaacgtgcgcaccatcttgtccttccgcgcgttcaccaccgcgtcgcccggcgccaccgcctcccatacggtgtggacgtcgaggatcgcctacgccttgatggcccagaccgtgtagttgtccgcggtcagcaaaggcatcgccatcgtcgccgattccgcccgcgccgccgccgtgtgggacgggcgccatggtcgccggtgatcgcccgaaccaaagctctgtatatcaattgttggaagcgctctctcacactgatggatggagatagaagaagaaggagcacacagtacaatggagtttcacccggcttcacagccctgttacttttcccagagccccaaaaactctcctcaacaaatacactcgtggtcatggctttgtagtggcacaacaacacaacgcccacgtttccttgtgcgcacgtatgcacaccgcctagctagctaccctgcatgcaatccatcagcccggccatgcgcactacatgcgcgctatgcgcatgacgcggccatctccaccggtcactgctaacaatcagctaactaactcacacgcatcaagcaaacttggccggcacacttgccaacgccctgctctatgtgctagactcgagtgtatacacgctacacacacatatgccacgcttctgcgtcccgcatgtcccgcacgtcaccgacgcgcctgacaagcccgacgagcccgacggcaccagtgtgtgccgcccgttccgcgtgcacccgatgcgctcgacgagcccgatcacacacgccgtggcttattccaacacctagatgtataattaatgtatacattaattgtctgacacggtgctatatcttcatgatatacaactggtgtatgcgtctgtatcatcatctcaaagaaggctatatataccaagacatagctagcgaagtcatgtatcccacacattcacagaagcca

SEQ ID NO: 10431 - DNA, 1992 bp, maize Ub1 Promoter (cultivar Nongda 105)
tctgcagtgcagcgtgacccggtcgtgcccctctctagagataatgagcattgcatgcctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgaccaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgaggcggcacggcaggcggcctcctcctcctctcacggcacggcagcctacgggggattcctttcccaccgctccttcgctttcccttcctcgcccgccgtaataaatagacaccccctccacaccctctttccccaacctcgtgttcgttcggagcgcacacacacacaaccagatctcccccaaatccacccgtcggcacctccgcttcaaggtacgccgctcatcctccccccccccctctctctaccttctctagatcggcgttccggtccatggttagggcccggtagttctacttctgttcatgtttgtgttagatccgtgtttgtgttagatccgtgctgctagcgttcgtacacggatgcgacctgtacatcagacatgttctgattgctaacttgccagtgtttctctttgaggaatcctgggatggctctagccgttccgcagacgggatcgatttcatgatttttttttgtttcgttgcatagggtttggtttgcccttttcctttatttcaatatatgccgtgcacttgtttgtcgggtcatcttttcatgttttttttggcttggttgtgatgatgtggtctggttgggcggtcgttctagatcggagtagaatactgtttcaaactacctggtggatttattaaagatctgtatgtatgtgccatacatcttcatagttacgagtttaagatgatggatggaaatatcgatctaggataggtatacatgttgatgcgggttttactgatgcatatacagagatgctttttttttcgcttggttgtgatgatgtggtctggttgggcggtcgttctagatcggagtagaatactgtttcaaactaactggtggatttattaattttggatctgtatgtgtgtgccatacatcttcatagttacgagtttaagatgatggatggaagtatcgatctaggataggtatacatgttgatgttggttttactgatgcatatacatgatggcatatgcagcatctattcattcatatgctctaaccttgagtacctatctattataataaacaagtatgttttataattattttgatcttgatatacttggatgatggcatatgcagcagctatatgtggattttttttagctctgccttcatacgctatttatttgcttggtactgtttcttttgtcgatgctcaccctgttgtttggtgttacttctgcag

SEQ ID NO: 10432 - DNA, 1358 bp, Ub1 Promoter (cultivar B73)
gtgcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcaccggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctccccccccccctctctaccttctctagatcggcgttccggtccatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaaatctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttc

SEQ ID NO: 10433 - DNA, 1266 bp, rice actin 1 Promoter
tagctagcatactcgaggtcattcatatgcttgagaagagagtcgggatagtccaaaataaaacaaaggtaagattacctggtcaaaagtgaaaacatcagttaaaaggtggtataagtaaaatatcggtaataaaaggtggcccaaagtgaaatttactcttttctactattataaaaattgaggatgttttgtcggtactttgatacgtcatttttgtatgaattggtttttaagtttattcgcgatttggaaatgcatatctgtatttgagtcggtttttaagttcgttgcttttgtaaatacagagggatttgtataagaaatatctttaaaaaacccatatgctaatttgacataatttttgagaaaaatatatattcaggcgaattccacaatgaacaataataagattaaaatagcttgcccccgttgcagcgatgggtattttttctagtaaaataaaagataaacttagactcaaaacatttacaaaaacaacccctaaagtcctaaagcccaaagtgctatgcacgatccatagcaagcccagcccaacccaacccaacccaacccaccccagtgcagccaactggcaaatagtctccacccccggcactatcaccgtgagttgtccgcaccaccgcacgtctcgcagccaaaaaaaaaaaaagaaagaaaaaaaagaaaaagaaaaacagcaggtgggtccgggtcgtgggggccggaaaagcgaggaggatcgcgagcagcgacgaggcccggccctccctccgcttccaaagaaacgccccccatcgccactatatacatacccccccctctcctcccatccccccaaccctaccaccaccaccaccaccacctcctcccccctcgctgccggacgacgagctcctcccccctccccctccgccgccgccggtaaccaccccgcccctctcctctttctttctccgttttttttttcgtctcggtctcgatctttggccttggtagtttgggtgggcgagagcggcttcgtcgcccagatcggtgcgcgggaggggcgggatctcgcggctggcgtctccgggcgtgagtcggcccggatcctcgcggggaatggggctctcggatgtagatcttctttctttcttctttttgtggtagaatttgaatccctcagcattgttcatcggtagtttttcttttcatgatttgtgacaaatgcagcctcgtgcggagcttttttgtaggtagaagatggctgacgccgaggatatc

SEQ ID NO: 10434 - DNA, 2199 bp, rice GOS2 longer Promoter
tctagaatccgaaaagtttctgcaccgttttcaccccctaactaacaatatagggaacgtgtgctaaatataaaatgagaccttatatatgtagcgctgataactagaactatgcaagaaaaactcatccacctactttagtggcaatcgggctaaataaaaaagagtcgctacactagtttcgttttccttagtaattaagtgggaaaatgaaatcattattgcttagaatatacgttcacatctctgtcatgaagttaaattattcgaggtagccataattgtcatcaaactcttcttgaataaaaaaatctttctagctgaactcaatgggtaaagagagagattttttttaaaaaaatagaatgaagatattctgaacgtattggcaaagatttaaacatataattatataattttatagtttgtgcattcgtcatatcgcacatcattaaggacatgtcttactccatcccaatttttatttagtaattaaagacaattgacttatttttattatttatcttttttcgattagatgcaaggtacttacgcacacactttgtgctcatgtgcatgtgtgagtgcacctcctcaatacacgttcaactagcaacacatctctaatatcactcgcctatttaatacatttaggtagcaatatctgaattcaagcactccaccatcaccagaccacttttaataatatctaaaatacaaaaaataattttacagaatagcatgaaaagtatgaaacgaactatttaggtttttcacatacaaaaaaaaaaagaattttgctcgtgcgcgagcgccaatctcccatattgggcacacaggcaacaacagagtggctgcccacagaacaacccacaaaaaacgatgatctaacggaggacagcaagtccgcaacaaccttttaacagcaggctttgcggccaggagagaggaggagaggcaaagaaaaccaagcatcctcctcctcccatctataaattcctccccccttttcccctctctatataggaggcatccaagccaagaagagggagagcaccaaggacacgcgactagcagaagccgagcgaccgccttcttcgatccatatcttccggtcgagttcttggtcgatctcttccctcctccacctcctcctcacagggtatgtgcccttcggttgttcttggatttattgttctaggttgtgtagtacgggcgttgatgttaggaaaggggatctgtatctgtgatgattcctgttcttggatttgggatagaggggttcttgatgttgcatgttatcggttcggtttgattagtagtatggttttcaatcgtctggagagctctatggaaatgaaatggtttagggtacggaatcttgcgattttgtgagtaccttttgtttgaggtaaaatcagagcaccggtgattttgcttggtgtaataaaagtacggttgtttggtcctcgattctggtagtgatgcttctcgatttgacgaagctatcctttgtttattccctattgaacaaaaataatccaactttgaagacggtcccgttgatgagattgaatgattgattcttaagcctgtccaaaatttcgcagctggcttgtttagatacagtagtccccatcacgaaattcatggaaacagttataatcctcaggaacaggggattccctgttcttccgatttgctttagtcccagaattttttttcccaaatatcttaaaaagtcactttctggttcagttcaatgaattgattgctacaaataatgcttttatagcgttatcctagctgtagttcagttaataggtaatacccctatagtttagtcaggagaagaacttatccgatttctgatctccatttttaattatatgaaatgaactgtagcataagcagtattcatttggattattttttttattagctctcaccccttcattattctgagctgaaagtctggcatgaactgtcctcaattttgttttcaaattcacatcgattatctatcgattatcctcttgtatctacctgtagaagtttctttttggttattccttgactgcttgattacagaaagaaatttatgaagctgtaatcgggatagttatactgcttgttcttatgattcatttcctttgtgcagttcttggtgtagcttgccactttcaccagcaaagtttc

SEQ ID NO: 10435 - DNA, 1024 bp, rice GOS2 Promoter
ggttgttcttggatttattgttctaggttgtgtagtacgggcgttgatgttaggaaaggggatctgtatctgtgatgattcctgttcttggatttgggatagaggggttcttgatgttgcatgttatcggttcggtttgattagtagtatggttttcaatcgtctggagagctctatggaaatgaaatggtttagggtacggaatcttgcgattttgtgagtaccttttgtttgaggtaaaatcagagcaccggtgattttgcttggtgtaataaaagtacggttgtttggtcctcgattctggtagtgatgcttctcgatttgacgaagctatcctttgtttattccctattgaacaaaaataatccaactttgaagacggtcccgttgatgagattgaatgattgattcttaagcctgtccaaaatttcgcagctggcttgtttagatacagtagtccccatcacgaaattcatggaaacagttataatcctcaggaacaggggattccctgttcttccgatttgctttagtcccagaattttttttcccaaatatcttaaaaagtcactttctggttcagttcaatgaattgattgctacaaataatgcttttatagcgttatcctagctgtagttcagttaataggtaatacccctatagtttagtcaggagaagaacttatccgatttctgatctccatttttaattatatgaaatgaactgtagcataagcagtattcatttggattattttttttattagctctcaccccttcattattctgagctgaaagtctggcatgaactgtcctcaattttgttttcaaattcacatcgattatctatcgattatcctcttgtatctacctgtagaagtttctttttggttattccttgactgcttgattacagaaagaaatttatgaagctgtaatcgggatagttatactgcttgttcttatgattcatttcctttgtgcagttcttggtgtagcttgccactttcaccagcaaagtttc

SEQ ID NO: 10436 - DNA, 2103 bp, arabidopsis Pho1 Promoter
actgtttaaggacaaaaaatgtggaactgatgtctcctaggtggtggaatatgtgaagctagaaaacaaataaatgcggtccgactcagaccatcattttcctcttgtctcattggttttaaaattaaatattatattataaaatctgttgcagtattttttttaatctcaattagagttatttatttaggtctcaacccatggtggggaaaaaaacagctattttaggtaaatttagattacaaaattgtatagtcaatatcaataataggttaaagttttaataaactgggtgaatcagtttttgtttggtcttcttggatctttgtttggtctcaatattttggattacatataaattccatcccgactattatttgggttttgccgctggactctataacacactgattttagttttatatgaattttacgttgttttacgtttgatcatgaactaaaaattcagcaatccataagaaaatattttttggactagttcgaaactcggccagacaatactaaacctattcacatatttaactttttttttttttggacaaacataattaactttagtaagtgttatatttttgtcaatattaaactagatgtggtgtttttaattgtgggaaataaaattaaagaagcaaagttccatgaaatatggactttccgtaattggaaggccgccatatgttgccttcatttgtattttccttttattgacccttttgttttcttataagataaatatatatataactaattaggcagaagctgagtggcattagttagtgaaatatatttatcattatcccaaattcctctagctgacattactttgaatttagaaatttcttatccgcaaaatttgtactaatattatgaagtagtacatcgaatagaatatatattggtgcacattatgatccactttcaatgccatccattcgaatggttgctcagaacgtacttgtagaaaccgcgtgcataaagtttcatatgagcatcgtgtgctttgttatttaattttttcttccctaaataatcagacagaaaaattcataaacttctttaataaaaccatccaaaaggggattatactacgaaaattatggcatctaaacgcaaagtttaatatatttttagtaccaatgcattgtaaaagaatggaaattaaataaaaacaatatgaaactgtttgttcccttggacaaaaaaaaaacttggtatgactatgatttttatatgcgcttttgtaattgcattgtaattttgtcgatatggaagtggattttaaagaacattaatccatgatctgataggtgaaaactcacactacttgactgctatataacatggtttggtagtatctgcatttgtaatgtgaaactatgaaatcagaatttgattggtaattcttcttctgcttcttttttcttgattctttaagatttagtatgtgtttcaaatttttcattgtcctccgaaaaaatgtagtggaaatcgagctggtccaatctaagttcactcaccttttgtgtctcttggcacctaatttctttttggtccatttcagctatcttcttccttttccacacaaaacattacaaaatacttactatttctagttctccgatttacaatacccaaattacccttacccttgcccctcatatagttcgtataacaactttcactctaagatgaaacattttgagtgttgagaaaggtatatgaagctcggtagccggaggaagcacggtggatatacactggcgagaatcaggacggtcccacacgagacaagatttacctctcccaaaagcacaagtggaaggagcataggataaaaattagtacatgaaattaggtttcaagaaggatatttgagaatgtgctttgtgaggcatcgtcagtaggagtaagcaatccagtcaaatatattcttctttttttctctgcctttgcttttgtccactataaaacaaatctcatcctcctctcttgccctacactcacaaaacaaacacactctcttcttgatcattttctcttttgagtttttgagtttaaggacttaaaagagaaaacgctatg

SEQ ID NO: 10437 - DNA, 901 bp, rice ExpB5 longer Promoter
gttgatgggccgtagaggagtataatggcaacgtttgacgagacatctagaaattataaaaataaaacccaacgtgacaataaactctaaaaactataaaatctattttttaaaggttccaagaagtatgaatagaaatagtgatagatcgagcaagcaaataaagaagaagatgacataaggggtagtaattggtgtgacttttaaaaactatataattaaaaacacgagaatgatatggtttggtctttcaaagtcttaagataatgagatagctatttaacaaattttgaataaatcatattaaaatagataattttgtatgggtgctaattgcgcgggctacccagctagttcgattgaattgctgccactaagtgttactatacaacattctcctctaaaagaactatatatatttctccaaaagaaaaaggaactatatatgtaccatatgtacaaacattcgagtggccgggcatgatactcgctactttgctaggcacgttgcgcacgtacagctcacgctcaagtcgtacacattatggagtagccatttgacaaacgtacggatgacacaagacgaatatcaaattgcgaattttcaaagcgtttctaaccaacacaactaccttgtgagaatagtttatccaaacccttgcggctgcgtgatcacctccttcatgcaaggacctccgtaaagtccacaagtatactcttcgatcccacacacacatagttgacatacacatcaacacatgtacaaattcaagttgccacgttcacctcaataatgcttgggtacacataatttgctaccacgtttgtgaccgctaatcttccctataaataccaaccaaatcaaatcatcttaaaaatcaccgagcaatctccgcttaac

SEQ ID NO: 10438 - DNA, 844 bp, rice ExpB5 Promoter
taaaaataaaacccaacgtgacaataaactctaaaaactataaaatctattttttaaaggttccaagaagtatgaatagaaatagtgatagatcgagcaagcaaataaagaagaagatgacataaggggtagtaattggtgtgacttttaaaaactatataataaaaacacgagaatgatatggtttggtctttcaaagtcttaagataatgagatagctatttaacaaattttgaataaatcatattaaaatagataattttgtatgggtgctaattgcgcgggctacccagctagttcgattgaattgctgccactaagtgttactatacaacattctcctctaaaagaactatatatatttctccaaaagaaaaaggaactatatatgtaccatatgtacaaacattcgagtggccgggcatgatactcgctactttgctaggcacgttgcgcacgtacagctcacgctcaagtcgtacacattatggagtagccatttgacaaacgtacggatgacacaagacgaatatcaaattgcgaattttcaaagcgtttctaaccaacacaactaccttgtgagaatagtttatccaaacccttgcggctgcgtgatcacctccttcatgcaaggacctccgtaaagtccacaagtatactcttcgatcccacacacacatagttgacatacacatcaacacatgtacaaattcaagttgccacgttcacctcaataatgcttgggtacacataatttgctaccacgtttgtgaccgctaatcttccctataaataccaaccaaatcaaatcatcttaaaaatcaccgagcaatctccgcttaac

SEQ ID NO: 10439 - DNA, 602 bp, barley ExpB1 Promoter
cgtggagttgaaactggttcggggtttgcgtcgtcgcccaactcgcttgtccgtcggctccggccggtggtaaagacgaggagatggcaccgcaggaaaacaaggctgtcttcgatggccgacgacttgagacaccgttattttgatgaaggcaccatgaaggctttcggtgtcgctttaccttcgggggacatcgtttttggagtagctacaggctagagggatgggtcaggatggaccgtttatgaaacgtgcgaacattttatttgaagggtacgaaacattttgaaggctgcataggatggaccgttgaaccccacgtgcacgcaatcacgcaacaaacccggccggatgagtcctctttatccaaaatctccggagttgaaagagccttcagcgccatggctccgtcatcaaaggatcggccggctccgtctcagttgaccacagtgcaaagtatgtatgcgcaccctctccgtgaacaagttgccgccacgttcgcctccataattcgtgtgtgcacgactaaacgtattcgctcccacgtttataacacctagaccttccttatcctatatataccaaccaaccgaaccacccca

SEQ ID NO: 10440 - DNA, 1729 bp, Barley SS2 Promoter
gaattgtagtaagtcacgggtgtttatttgatccagactcttttgtaaactaaaggcctctacctacatataaaggagagccctcgagttagaaagatcaagtaaacaactctcgagagctaggttagtgattacgcatccttgtagttgagatccccatcaacatagacaccaaagcaggacgtaggcttttatctccattgaaggggccgaacctgggtaaatccacctctcgttcccgattaacctcttcgagtcgccacaccgccatgatggcctcaacactaagtccgttcacgagctaggtcatgtcgtttggtgacattggccctagactcggagcccgacatcatggggacgaggctccatcgctagggttgcgctccaccccgtgtagttagtcgccactctacctacaaccaatgctcaccacctccattccgtcgcgctcacgcaccttgagttgtcgacgccgctggaaccgagccccactcttgtggatgcaatggggccagagtgactccgacaacggagctcgagtttcctctcgggactagcaaagtgccagctggacgactaactcctcctcgtccgcacatgaggacgaggtcccacccgatggatccagagttgtcaaattcaggctcgctattggccatgtcagaaaagggtggagatcactagagaggagttgggggtggagcggagtggactcggagtgggtggttagggtttcgtttggatagggacacattatgaggccgaggtgggttggtcggggcaagattcaatgtgaagaatgtgtcggggcacctcatatgacatatatgaccggtttaagggtccgattagatggcattttcgtgactagaccgtccgctcagacataaatggacgtgttaagtgcaagacaagttacaaaccaacatgtatatcaaatttaagttctaaactacactcatgcttatatttttcttaaattatttcaaaccttccaacgatgcgacttcaccaggagatgtttctgtcatgaacatatatgcaaatgtattttgcgttaccgtgtttcaaaaagaaaaaagtattccatccgtttttaaatataaaaccttttagagattttactgtagactacgtactgcgatggaaattaaaatgcaaaccacatggcagcggcatacgagagccattcatcgctacaggacactttgcatcggtagccagctagtttccgacggtaccgacgagccgcagagaacttctaaatgcggtttttatgtgcagggacaaacgcgggtttctctgtctgcggaacagaaaaacaaattcggttcccagcaaaaacaaaacaaaacaaagaaacaaaaaaactgcggttgcacgtagtaacaaagtctgtcgcgcacggagcatctcatgcagccgatgatggctcgccagcacgaaaacacttgtcacggcgcgctcccacgaaccggaaacacttggcgcggtgcgtccctccgaaccgaagcacctgtctctaccgcctcgggaaccgggcgctaatctccaaatcaggccggaggcctccacggccgtcgatgcgatgccgccaagagccagtgcggaaaagagagtgtccttttcccccggccgcccggcgagaggaggtggcagcggcgcctgacgcacgcctcctgctggcagctcctccggcgcgccgcgtgtataaataggggcgcagcgc

SEQ ID NO: 10441 - DNA, 879 bp, rice PG5a Promoter
aagcttgcgcgcggaatacggtggtggagatgggttgggaaccctggattccaaacacagcccaagtctatccaaaatgtttagacaagaaaatacgtaacaagttggtttacagaaatagcaattagatcaatcctgcactacaagtagagtaaagtggtgatttctcttaaatctctcgaatggtgatttaagaattcagtgcaaaccaaatccttgctataatcaaatgttcggtaccccatcaacggaacaataaaaagcgcctggctaccataattttgtcattcttcttcaatttgtaatttaagatgcatgaggccacacgaccttaatgttcaacgtgtcatgcattagtgaaataatagctcacaaaacgcaacaaatatagctagataacggttgcaatccttaccaaactaacgtataaagtgagcgattagtcatatcattatctcccgcctgctaaccatcgtgtacaccatccgatccaaaaatgacaacttctagggatgaacctggacaaggtttagggtttagggatgaatctggacaatgattgttcaggttcatccctagatgttgctttctccttacgggacggagggagtatatgtgatggacacaaaagttactttcatgatgaaaggaaaggggatttgttggggcactaatagaacatctgtccaaatggcatgactcacttatatcctaataggacatccaagaaaaactaacactctaaagcaaccgatgaggaattgaaagaaaatacgtgccaccgcatctataaatggacaagcgcaatggaaaccctcctcatcgttcacacagttcaagcattatacagcaaaatagaaagatctatgtcccagagca

SEQ ID NO: 10442 - DNA, 666 bp, CaMV 35S (QFNC) Promoter
gcatgcctgcaggtcaattctcatgtttgacagcttatcatcggtgcgatgccccccatcgtaggtgaaggtggaaattaatgatccatcttgagaccacaggcccacaacagctaccagtttcctcaagggtccaccaaaaacgtaagcgcttacgtacatggtcgataagaaaaggcaatttgtagatgttaacatccaacgtcgctttcagggatcccccctcagaagaccagagggctattgagacttttcaacaaagggtaatatcgggaaacctcctcggattccattgcccagctatctgtcacttcatcgaaaggacagtagaaaaggaaggtggctcctacaaatgccatcattgcgataaaggaaaggctatcgttcaagatgcctctaccgacagtggtcccaaagatggacccccacccacgaggaacatcgtggaaaaagaagacgttccaaccacgtcttcaaagcaagtggattgatgtgatatctccactgacgtaagggatgacgcacaatcccactatccttcgcaagacccttcctctatataaggaagttcatttcatttggagaggacaggcttcttgagatccttcaacaattaccaacaacaacaaacaacaaacaacattacaattactatttacaattaca

SEQ ID NO: 10443 - DNA, 781 bp, PJJ 35S from Brachypodium Promoter
tcgacctgcagccaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgctagagcagcttgagcttggatcagattgtcgtttcccgccttcagtttagcttcatggagtcaaagattcaaatagaggacctaacagaactcgccgtaaagactggcgaacagttcatacagagtctcttacgactcaatgacaagaagaaaatcttcgtcaacatggtggagcacgacacacttgtctactccaaaaatatcaaagatacagtctcagaagaccaaagggcaattgagacttttcaacaaagggtaatatccggaaacctcctcggattccattgcccagctatctgtcactttattgtgaagatagtggaaaaggaaggtggctcctacaaatgccatcattgcgataaaggaaaggccatcgttgaagatgcctctgccgacagtggtcccaaagatggacccccacccacgaggagcatcgtggaaaaagaagacgttccaaccacgtcttcaaagcaagtggattgatgtgatatctccactgacgtaagggatgacgcacaatcccactatccttcgcaagacccttcctctatataaggaagttcatttcatttggagagaacacgggggactcttgaccatgg

SEQ ID NO: 10444 - DNA, 877 bp, CaMV 35S (OLD) Promoter
aagcttgcatgcctgcaggtccccagattagccttttcaatttcagaaagaatgctaacccacagatggttagagaggcttacgcagcaggtctcatcaagacgatctacccgagcaataatctccaggaaatcaaataccttcccaagaaggttaaagatgcagtcaaaagattcaggactaactgcatcaagaacacagagaaagatatatttctcaagatcagaagtactattccagtatggacgattcaaggcttgcttcacaaaccaaggcaagtaatagagattggagtctctaaaaaggtagttcccactgaatcaaaggccatggagtcaaagattcaaatagaggacctaacagaactcgccgtaaagactggcgaacagttcatacagagtctcttacgactcaatgacaagaagaaaatcttcgtcaacatggtggagcacgacacacttgtctactccaaaaatatcaaagatacagtctcagaagaccaaagggcaattgagacttttcaacaaagggtaatatccggaaacctcctcggattccattgcccagctatctgtcactttattgtgaagatagtggaaaaggaaggtggctcctacaaatgccatcattgcgataaaggaaaggccatcgttgaagatgcctctgccgacagtggtcccaaagatggacccccacccacgaggagcatcgtggaaaaagaagacgttccaaccacgtcttcaaagcaagtggattgatgtgatatctccactgacgtaagggatgacgcacaatcccactatccttcgcaagacccttcctctatataaggaagttcatttcatttggagagaacacgggggactctagaggatcc

SEQ ID NO: 10445 - DNA, 2322 bp, Arabidopsis At6669 (OLD) Promoter
aagctttaagctccaagcccacatctatgcacttcaacatatctttttctagatgagttggtaaaagtagaaaaagatatgatgattttaaatttgtttctatttatatgtgttcatcgaaacttcattttttttagttttaatagagagtttatatgacttttaaaaattgatttaaaactgtgtcaaaaattaaaaggacaataaaaaatttgcatacaaccgaaaatacttatatttagacaagaaaaaataatacttgtgatgctgattttattttattatatatcatgaatcatgatcatccaattttccggataagccaaagtcaaaatgatgggttccccctaatcttttatgctgagaaatagatgtatattcttagatagtaatataaaattgggttaaagaatgatgattcgattatagcctcaactagaagatacgtgtagtgcaggtgtgtagttaactggtggtagtggcagacaaccagattaggagttaaataaagcctttagatttgagagattgaaatattcgattggaacctttctagatttttacagccatctaaaattagatgcagatcacctactaccattcaaaaatgaacaaaataatttcatttacattttcctagcataagatataataataaaatagtgctcattttaattactttttctaaatattttcgttattttaaattttgcttgtctatactctacagctcatttaataacggaaacaaaaataattgcagggatacggatgggtagctttcaaaacttacatcatcttctgtttcttgagatcaactatttttggagctttgtctcaatcgtaccaaaggataatggtcctacctccttttgcattcttaactttatcttctctacttatttcttttttgggatttttgggggtattattttatcttttgtagatatacacattgatttactacaaacgtatactactatccatcttcaactcttcggaatatgatttcgaaaaaactatgaagattaacgggtatcttaaacatgttaagatacaccggacaattttcatttagaagaattgatatgcaattaacaataaatagttgatgatcttttagttttgaagatgtgcgttaagacttaagcgtgtggtaacaaggtgggactcgggcaacgcaaagccttgtagagtccacttgctcaacttgtctttcttttatctcttttccaagtctcaagattcaatgaactccgtgtaacacaaacacgcccatagatgagctcatttttggtatttccaatattgccactccatgataatatcatctagggatggggttcatttattttgaaatctcaacaaatctcgtcgattctaacacacatgattgatttgtttacttacttgaaagttggcaactatctgggattaaaatttatctttttctactgctagctagaagcatctatatatgttagcctaatacgtggaagatgtcattgctaataatggctaaagatgtgtattaatttttcttcttttttccttgaatttttgttctttgacataaactatgctgtcaaaatgtgtagaatctttttacataaatcattccctgttacacactaaaaggttcacaacggacgattgtattggacttccagatcataaaccatgcaaaactgaaaaccacaagaataattagttctaactttagaacgttcgtacgtgtttcatgttcaaaaagcgtcaattataaaagttgggaaattacttttgagttttgacatttctaaggacagtcaaatatgacaacattgggatgcaacttaccttgtattaacttattttgttataaaaccatatattacatattttaaagggttgataaataatcaaatataccaaaacatagcttttcaatatatttgtaaaacacgtttggtctactagctaattatgagaacatttgttcaatgcatgattatctagtatctactagtggattatgaaaattagatattttcattgcatgattatcttccatatatagtgataacatcaaaagaatctacaccaattattgcattttttcattatataataagcactaaactgtaaaattatattcagccacccaaaccatgacaaatcaccttaaaggcttaaacacataacagccattacgagtcacaggtaagggtataatagtaaagaatcaatctatataatatacgacccaccctttctcattctttctggagagtaacatcgagacaaagaagaaaaactaaaaaagagaaccccaaaggatcc

SEQ ID NO: 10446 - DNA, 2318 bp, Arabidopsis At6669 (NEW) Promoter
aagctttaagctccaagcccacatctatgcacttcaacatatctttttctagatgagttggtaaaagtagaaaaagatatgatgattttaaatttgtttctatttatatgtgttcatcgaaacttcattttttttagttttaatagagagtttatatgacttttaaaaattgatttaaaactgtgtcaaaaattaaaaggacaataaaaaatttgcatacaaccgaaaatacttatatttagacaagaaaaaataatacttgtgatgctaattttattttattatatatcatgaatcatgatcatccaattttccggataagccaaagtcaaaatgatgggttccccctaatcttttatgctgagaaatagatgtatattcttagatagtaatataaaattgggttaaagaatgatgattcgattatagcctcaactagaagatacgtgtagtgcaggtgtgtagttaactggtggtagtggcggacaaccagattaggagttaaataaagcctttagatttgagagattgaaatattcgattggaacctttctagatttttacagccatctaaaattagatgcagatcacctactaccattcaaaaatgaacaaaataatttcatttacattttcctagcataagatataataataaaatagtgctcattttaattactttttctaaatattttcgttattttaaattttgcttgtctatactctacagctcatttaataacggaaacaaaaataattgcagggatacggatgggtagctttcaaaacttacatcatcttctgtttcttgagatcaactatttttggagctttgtctcaatcgtaccaaaggataatggtcctactcccttttgcattcttaactttatcttctctacttatttcttttttgggatttttgggggtattattttatcttttgtagatatacacattgatttactataaacgtatactactatccatcttcaactcttcggaatatgatttcgaaaaaactatgaagattaacgggtatcttaaacatgttaagatacaccggacaattttcatttagaagaattgatatgcaattaacaataaatagttgatgatcttttagttttgaagatgtgcgttaagacttaagcgtgtggtaacaaggtgggactcgggcaacgcaaagccttgtagagtccacttgctcaacttgtctttcttttatctcttttccaagtctcaagattcaatgaactccgtgtaacacaaacacgcccatagatgagctcatttttggtatttccaatattgccactccatgataatatcatctagggatggggttcatttattttgaaatctcaacaaatctcgtcgattctaacacacatgattgatttgtttacttacttgaaagttggcaactatctgggattaaaatttatctttttctactgctagctagaagcatctatatatgttagcctaatacgtggaagatgtcattgctaataatggctaaagatgtgtattaatttttcttcttttttccttgaatttttgttctttgacataaactatgctgtcaaaatgtgtagaatctttttacataaatcattccctgttacacactaaaaggttcacaacggacgattgtattggacttccagatcataaaccatgcaaaactgaaaaccacaagaataattagttctaactttagaacgttcgtacgtgtttcatgttcaaaaagcgtcaattataaaagttgggaaattacttttgagttttgacatttctaaggacagtcaaatatgacaacattgggatgcaacttaccttgtattaacttattttgttataaaaccatatattacatattttaaagggttgataaataatcaaatataccaaaacatagcttttcaatatatttgtaaaacacgtttggtctactagctaattatgagaacatttgttcaatgcatgattatctagtatctactagtggattatgaaaattagatattttcattgcatgattatcttccatatatagtgataacatcaaaagaatctacaccaattattgcattttttcattatataataagcactaaactgtaaaattatattcagccacccaaaccatgacaaatcaccttaaaggcttaaacacataacagccattacgagtcacaggtaagggtataatagtaaagaatcaatctatataatatacgacccaccctttctcattctttctggagagtaacatcgagacaaagaagaaagactaaaaaagagaaccccaaaga

SEQ ID NO: 10447 - DNA, 1321 bp, RBCS Promoter
ccaagagtcgttgtctccatgacaacgcccccaaggaggaaatcgacgtaaaaacgccgttgtcgcccgatctggccatagccaaatcttaggttttcacccgaagacaccaaacatcaaagtgagggaaagtgaagctcttcgacgacacctccaagaaggaaaacggcgctacaacatcgttgtcttcggcatacctcgcacacgggcagttttcatccagagcaacactccaaacaccggagccgacgtccatacctcgcacacgggcagcagccgaagacgcgaccgaaaatgaaaaccacgccaccatggcatcgaaaaggaccgacttggaccatgtatggccgcagcagcagcccatctgccgccggtgaagttcaatcagccgcctcaccaaactgagaggaaaaatgatggaaacgaagagacctgggacatgccggatcagccggaggagatgacggatctggccaacgagtagctagatccggccgaagagcgccgccgtgaagccgcgcagccacgagcagaccgagcaccagggagaggaagaacgaggggaaacaccggatccgggaggaagccggccggatctagccgaagacgaggcatagcctgccggatcgggccggagacgccgcgaccacgatgaggcagcacctcaaacgcctcagccaagagctctaggacacccccgccaagaaaaacagccccgccgccgccgtccccgtgcgggctttgcccggcggcggcgagggggaggagaggacggggagaggctgctgccggggctggtgtggttgccgcccgtgtcgccccagactgagcgacgcgggggcaagcttcgttctcgataagatcttagaagagtttctcttaatttgttgttcctctagttcataaaaagtgctgctcattttgcattaactcattacaaattttctaataagtgggcgagattttttatggattggagggattagcaagttctgtttttgagtgcatgccgtggcacattggatctatcctgataggtgaaaattggtcacttcatggcatgatttgcagagtgcgttgcagccaattgtatccgtccagaggataacgcgcgccatttcgtgcggccatgtggcgcccgacctgatccgtaggatgccagcgtggcctgggcaaatccgcgcggcgaactgcagccacccctcctagatcttgtgctgatattggatgggtggggagcctacagttatataagccgctgtagctagagagcactcaagcaagcctgcctcctcttgttagctatctacgtacgtgtacg

SEQ ID NO: 10448 - DNA, 1599 bp, Arabidopsis AT5G06690 Promoter
ggaccatttgtttagacgacattgttaaggggatgacttaaagtgatgagtttcaaattaaaatacccctcgtttttggagttatttacttaaaatgccacttcaaagaagcgtgtcggtgtgttcgagattcgaattttaattactgtcttttgcccctatctatatatatctcactttaatcacacttttattatcgttaatgtttaatgtttatttatgttaatgaaggattagtggttagtggttgtgttactaattgttcgttgctaatgtccttgaaaggtgtaatttgtatgatctatctaactaaattatccggaaataatgcggttgaaataaaatcacgatacatattaggatatcacaatctatttatagtatattttagtcgagatttgaaaataaaaagggaatatattactcgattaaagacattttcaaacgcaaaatcgtatataactatagattgaatcatatatatatctgtgactcaagtcttttatctttgttttttggtttaatgttaaaactttatatcaacaaagacttttatcttgtatcttatgtttactatttctgatgagtaaatattaattttgtaggtaagtaaggtggcaggtttgggtaaagaggaaatcaaaaatgtatggtaggatagtacttgacaaaatacaaaattctaattcgcgtttattaaagtccttagcgtgtggactctacttgtttaatttcgactctctaaacgtcggcctttattttctttcaaacgtacttcaccaactctattagagagatcgattataaccgacaagcataagtatgtgatttctatattagtttatatatagctatgtcttcgaatgattatttatagtaaacacataattatacgtaataagtccgagagtatataaactatgaaggataattaattgaagacaagaaaattaacgaaatagtgtggggaattcccaaggcatcatattcagatcaatgcaccgtcacaagtttggctattctttatttggttttctgattaacacaaagttttaaatagttttgaacgtttctaatccatttgaggcagtgattttttctgttccaagtattttatgttcaatattattaggaatgtgaacggaacgatttttttttttttttgtggaaccgagcgaccaaatttgagaaaataaaacaaattagattgatttaacatttagacgaggtttaattagaaaggaaaaaaaaaacacaattttatataaatatgaacagccaaaataattttcctagagtttataagttcagggtttacctttttcatagagaaaactaataaagtcactattaacattttaagaatatacatttttaaaacaaattataaagacaatgagagaaaggtagcccccaccagtagcacatcgttggcattgtccaactcatcttccggataagctctctatccatctcctcacatctcttcccaaaactttcaaaaacaaaaaaaatatcttaattatggcatttgaaaacttaaaaatatctcgtcacatatcttcatcgacaaaaaatttactgaaagcgaaaaaaata

SEQ ID NO: 10449 - DNA, 1774 bp, Arabidopsis AT5G61520 (AtSTP3) Promoter
ctgttatgaggtgttcttgcacggcatgtctagttgcaggctgctgaagaattgcccaccggcttttaaacaacgacccaactctttctgcaacatctgcaacattcactttcgcatccttagcaacttccccgacaaaactaccagcagtctgccctgcttccctaagcttcgttcctaattcagtaactccatagtaagctttccaccataaacactcacagagagaaacgaaatgaggttagcatagaaattatcaaacctgatgaagaaaagaatccactagtcctctcctgccattgctgtgagatgagagaaggcattatccaataccaaccactttaaacaagtcactagaaacctgtttgcatcaagaaacaaatgggaagatatatacttattcttagcaaattatgatacaacctcacaagcggtattatccgttgtaatcaacttcatcacatgaaatcatcttcaatctaatcatatacaattgatacagaagaaacacaaaagaaaaccaaaaccttgacttcatcgtcaaccatggaatgaatttcttgacaaagaataaaaaccaagtctttaactgccaaaaggagataacttttaaggaacacaaaccctaatcctatattctctaatcaatcatatacgagaatcaaaaagaacaaatagaacaaaagcaatccgatcatcaaacctttagaacaatccccagaaaaattgagatagctgatgatcgaatcgaactaaacccaattcctcgatacgatcaaagacgacgaagacgagagtcagcgatatgatgaaaaagaaattgatcgctccaggagatgaaaaggttccacttttttaatttccccctggagcagagaaaaaaagatattattgctgtttaggtaaaaaaaaagtcggctttgaattttgaataggaaagtcttcttccctttgcaaatcacagatattctctccgtcacggactgtgacggtaataaatattctgttggtgccacgtgtaataagtttttctcttcacaaaaatggtccttcatcttcttttagtatctcatttgtgacctaagcttctaatttcacagcttatcatccccttaatgttttaagttttttgaccatagagtaaaattattttactataaaattaaaagcaaaaaataaaatttactataaaattataattataaaaagtgaatgtaaaaatgattccataaatttacatgattgatagtaattattctgccaacttaattccacatgtatatcagtatttatatatagaaaatgatggtttttctacatagtcaaattccaaaacaaaatatcagtattatggaattaaacaatcaaagtttgcaacttggtatgtccaatatcatcgaaagagctttatcattcagtcgttgaaaaaagtatagccatctttttcttctatcgattttcaaaaaaaaaaaaaaaaaaaaaaaaaaaaaaaaaaaaaaaaaaagaggaagataatgaaggtaggcagtgaaaagtctttcttcacatgtcttttattgtccactttcgatatctcatcagccagaaccgaaacaaacaaaaactataagtcccacactcaagtcaattaaagcactccaatggtccaacaagtttcgtcgtctaccttgaaactcaacctttggatgattgatatacaaaaatacaggatctaaaaacacctaccgaacttgaatagtaggtgtgttgtgtttgagtgtctctctaggtaaac

SEQ ID NO: 10450 - DNA, 1127 bp, Brassica napus NAPIN Promoter
attgattcctttaaagacttatgtttcttatcttgcttctgaggcaagtattcagttaccagttaccacttatattctggactttctgactgcatcctcatttttccaacattttaaatttcactattggctgaatgcttcttctttgaggaagaaacaattcagatggcagaaatgtatcaaccaatgcatatatacaaatgtacctcttgttctcaaaacatctatcggatggttccatttgctttgtcatccaattagtgactactttatattattcactcctctttattactattttcatgcgaggttgccatgtacattatatttgtaaggattgacgctattgagcgtttttcttcaattttctttattttagacatgggtatgaaatgtgtgttagagttgggttgaatgagatatacgttcaagtgaagtggcataccgttgtcgagtaaggatgacctacccattcttgagacaaatgttacattttagtatcagagtaaaatgtgtacctataactcaaattcgattgacatgtatccattcaacataaaattaaaccagcctgcacctgcatccacatttcaagtattttcaaaccgttcggctcctatccaccgggtgtaacaagacggattccgaatttggaagattttgactcaaattcccaatttatattgaccgtgactaaatcaactttaacttctataattctgattaagctcccaatttatattcccaacggcactacctccaaaatttatagactctcatccccttttaaaccaacttagtaaacgctcttttttttaattttatgaagttaagtttttaccttgtttttaaaaagaatcgttcataagatgccatgccagaacattagctacacgttacacatagcatgcagccgcggagaattgtttttcttcgccacttgtcactcccttcaaacacctaagagcttctctctcacagcacacacatacaatcacatgcgtgcatgcattattacacgtgatcgccatgcaaatctcctttatagtctataaattaactcatccgcttcactctttactcaaaccaaaactcatcaatacaaacaagattaaaaacatacaccc

SEQ ID NO: 10451 - DNA, 916 bp, Arabidopsis AT1G61720 (BAN) Promoter
ttgtacttttgaaattacagagatagagatttagttgttatgagtttatcgtcttgagacttctatataagaagtaaaaagatttgcaaatagtccttgctcattaggtacaacagtagatcaataaggctgttttagaaggtaagcacgtgatctttgaaataaccaacttgtcttcacctaagaatcaaaaaagattgaccttcagagttctgatttgttatcatctaccaaattatcacaagagtttgattatttctgtctctaaacaatataacacagctttagagtaacgaatagtgttacagtaaggttctgttacttcaattttttctttgccgatcttaaaatgagttgcaaaagaatgctttttacttccaccaatctgtcaaattctctgcagtttttaacacaacttggacttgctatgttctgtttcacgaattacacgagtcaattcaacataacttgctctgttcttgtccatgtttcacagaatctggccttaagcaattttatcatatttaagctacaaatccataacagagtttaacaaagataaaataaccagaaagttacattgaaagataaaaagtgaagaagacaaaaaaaagagagggtaaatcctaaatcgaaaacaaaagaaggcattggcaatagcattccgattttaaaaaaccgataaatctatgtatctaatggcttgttcttagaagcttcaacgaacatagaagcaacctcattcaaaaacttagtcttctccaacacaaattccaactccttagcttgcaacaacttatacttctcttcaacaatcttcttactctcaaccgaaaccaaactccattgctgcttcacataatactcatcaacacccaaactagcaatcatcctaacaagagacgagttatcaaac

SEQ ID NO: 10452 - DNA, 3965 bp, Arabidopsis ABI3 (AT3G24650) longer Promoter
catgttaagttttactagatacgttctcatctaactagatacgacctaaaatacgatatttgtggttttagttgttagatgttgtgtcacacgagagaaagaggtcgacgaagaaaaaaacaaaaagaagaagtaaaacgtagttattggcggacaagggataaagattgctttgaagtcagaaatgctgacacgtggcagcatatgaagacaacccgccgcttaaaaccacgaatggtgacgaaaggcttctttgtttgcatgtgcaaccaatctctctctttctctctgtctttactaattttggttgttcgtagaaaatgaaatatttgaacgaagaagataaaggttggtgatgtacgtatgactctaaattagagtttgataatttgtatgtaagattagatcggttttgttatttgcttgatccaatttattgaagtacatgtgaataatcgtgatatatgtcaatatatatgtgctataattaaatctattaacaaatttctttttatcgatttagttacaccatctttaatatatttctattttctattttaaactaaagcatagtttctccaatatattaatttatatatttactctaggatagaattagattcaaaaactagaatagagaatatagatgctctaaatagacaataattctattacttactctattttagagtaaaacatatagtgatgctgacaaaaatattattttataatagagtttagaaagaaaagaaaaaacaaaaaaaacttgaagatgctggaactattaaaaattaaagaaaaagtttaaaatgaataatgctttttattcttagttttttttttcttttttttcttttagttgatgttaaagttttagtcaaatctccaaaatttgcaaaaaagatacattagttacggacggatatatattaaataaattaagtcacaaatatcatatatatatatatatatattaattttttgcctagttttgttccaaataaaattttcaatttttagtgtacaatatttttcatcgtccaaatacacaaacacaacaaataataataccactaatttatttgttttctaatataattgaaccttttctaattttattaaataggctgaaaaccataaattatttggagccaagattaaattatgttacataaatccttttctcgtcatcaatactcaaatttaaatttttttattttcatagatatttttgggaatttaaaatccttccaaataaatttgggaaaataatagatgttttaaaatatttttgttattttcgagtagtttacactgattttacatcactttatggatcaagaccataaaatttaactacatttattataacttatttgaaaagacatgaaactttcattagagtttaggaaaatacggcaaactattagattatcaccctcttgtgactaatgttaatactatttggtaaagcaaataatcccataactaattttattttgatttgttcactatcaattgtatcatagacgatccgatgattaatgtacctaaattttgatttaaattgtattccttgtagtacgcatagtaaaacaaagttcacatgttcttttacaattggttttctaacattttagatttcattttaaactaaagaaaaagggtttttcgatcccaacaatttttaaagtatgtttttgaatttcaacaaacgactagtactgatatatacatcaatgcttacaaaaatcaaattatctatctcaacgtttacttttgtacgtaattacaagtcaatattaacaaatattagtcaactgtaacggttgttgactcaattgatacgtgtacgtttaggtggcatgttttttaataaaataattttgttttatgttttgggattaaaaatatttacttttaaaaaactaaaccgaaaaactggaacccccaacctcacatattcatcaccatcgtatccacaaacattatcgagacataaataataatttatagatatatagcaacaaattggaattaaattaatcaaacaatgtcatttagaattggggaaatcctaaccgacgttatatgattaattttaattccaatttatgtatgtgtatatatctataaattattatttatatattgatgatgttcgtgcatgatggtaatggtaacctttaaaacttttgaatctcaaaacgtaaaacaacgtcatttggtttgaagaacatgccatctcgacgtacaagtgttagctgattcaacaaccgttactgttaattaccataactaacgttgactcataattatgtacaaaagtaagagttgaggtagataatttgaattttttaaatgttaaagtatgaacattactaattgtttgttcagatttataaaacacagtacctattttgatgtgttaaaatgtaatcgggaaaataggaattttcccaagaaaaaaaaatacactaaaattttgatgtgttaaaatgtaataaatacaagtacctatttctttctacaacaggtatcacatgatctgctcaatctcattttgaaggcaaggtcgaaccctgtttgtaactaaatattttacaaatacactaaaagttttgttttgttttcctcatgcagaaaaaagaaaagaaagaagaagaaaaaaaactcacaaaaacatacattgttctacaatatgttaaagtaattgttctagggtaataaaatccgtgtctgcctcttccacttcaataggaaagtgtaagtttttcgaatctttttggccagataatttaaaaccgaccgaggaaacttacttttgtaaaagtgaccatttgcacataggaagtagaaagttgataattggaaaatttataatattttatacaaaagaagtgtttaagaaccaccgcttggtctcaccactcaaattcgaacgtatggctcgtgggcacaaactcctgtaccaacctttagatactagcggcacgaggagacttctattttctctttgtttttaagtttttttatcgacttaaatatggctttttgcaccatttaatttcaaaaccaatgtctttctctcgaggaactttgtttttatttcttagaagatgaggggagatttactatctaaataaaattttaaatgtttgtaagtattatgagctcaacaattttgtcaatagtgccacaaatttaaacgtttgctttttgtcttctttgaaaaatcaaatgctgaaaaactgttacatctctttttcttaaaaactcttgtctctctccttttccttctgctgaggtaattgaatgctgcaaagagaaagagaataacttaaacccaaaattacacttaccgccagaaaaaaaaaagagttcagtttaatctaacatattttatacaatacaattgaattatattagtaaaaaaaaaacttccatataaatcatggaacaaactggaacacatgggctctcttattttaatttattttcttttttgagggatttaaccatgtttattatatagttttataaatatatatataccatctctccataatttataaaatgaaagaaagagagagtcttcttgttggagtaaacccaaacggttttagattacttattagctgttcatcagttcttcctctctaaaagagtaaaacctaaacatctctctctgttctattagaaccaaagaccaatctttgtgaacaaaacacatctcgtatacttcagatctagactcgaaaattttagacctctttacaattggtctttgttcatctgaagttggagaaaatagttagcttaggtcggatcttttcatatgctttggatcctccttcgtctcttttgtataattttaaccttatcaagagttctttttgaatctcaaaagattatatagtagtatagaaggtttatatgtatatgtatagccagatagtttatgt

SEQ ID NO: 10453 - DNA, 4074 bp, Arabidopsis ABI3 (AT3G24650) Promoter
catgttaagttttactagatacgttctcatctaactagatacgacctaaaatacgatatttgtggttttagttgttagatgttgtgtcacacgagagaaagaggtcgacgaagaaaaaaacaaaaagaagaagtaaaacgtagttattggcggacaagggataaagattgctttgaagtcagaaatgctgacacgtggcagcatatgaagacaacccgccgcttaaaaccacgaatggtgacgaaaggcttctttgtttgcatgtgcaaccaatctctctctttctctctgtctttactaattttggttgttcgtagaaaatgaaatatttgaacgaagaagataaaggttggtgatgtacgtatgactctaaattagagtttgataatttgtatgtaagattagatcggttttgttatttgcttgatccaatttattgaagtacatgtgaataatcgtgatatatgtcaatatatatgtgctataattaaatctattaacaaatttctttttatcgatttagttacaccatctttaatatatttctattttctattttaaactaaagcatagtttctccaatatattaatttatatatttactctaggatagaattagattcaaaaactagaatagagaatatagatgctctaaatagacaataattctattacttactctattttagagtaaaacatatagtgatgctgacaaaaatattattttataatagagtttagaaagaaaagaaaaaacaaaaaaaacttgaagatgctggaactattaaaaattaaagaaaaagtttaaaatgaataatgctttttattcttagttttttttttcttttttttcttttagttgatgttaaagttttagtcaaatctccaaaatttgcaaaaaagatacattagttacggacggatatatattaaataaattaagtcacaaatatcatatatatatatatatatattaattttttgcctagttttgttccaaataaaattttcaatttttagtgtacaatatttttcatcgtccaaatacacaaacacaacaaataataataccactaatttatttgttttctaatataattgaaccttttctaattttattaaataggctgaaaaccataaattatttggagccaagattaaattatgttacataaatccttttctcgtcatcaatactcaaatttaaatttttttattttcatagatatttttgggaatttaaaatccttccaaataaatttgggaaaataatagatgttttaaaatatttttgttattttcgagtagtttacactgattttacatcactttatggatcaagaccataaaatttaactacatttattataacttatttgaaaagacatgaaactttcattagagtttaggaaaatacggcaaactattagattatcaccctcttgtgactaatgttaatactatttggtaaagcaaataatcccataactaattttattttgatttgttcactatcaattgtatcatagacgatccgatgattaatgtacctaaattttgatttaaattgtattccttgtagtacgcatagtaaaacaaagttcacatgttcttttacaattggttttctaacattttagatttcattttaaactaaagaaaaagggtttttcgatcccaacaatttttaaagtatgtttttgaatttcaacaaacgactagtactgatatatacatcaatgcttacaaaaatcaaattatctatctcaacgtttacttttgtacgtaattacaagtcaatattaacaaatattagtcaactgtaacggttgttgactcaattgatacgtgtacgtttaggtggcatgttttttaataaaataattttgttttatgttttgggattaaaaatatttacttttaaaaaactaaaccgaaaaactggaacccccaacctcacatattcatcaccatcgtatccacaaacattatcgagacataaataataatttatagatatatagcaacaaattggaattaaattaatcaaacaatgtcatttagaattggggaaatcctaaccgacgttatatgattaattttaattccaatttatgtatgtgtatatatctataaattattatttatatattgatgatgttcgtgcatgatggtaatggtaacctttaaaacttttgaatctcaaaacgtaaaacaacgtcatttggtttgaagaacatgccatctcgacgtacaagtgttagctgattcaacaaccgttactgttaattaccataactaacgttgactcataattatgtacaaaagtaagagttgaggtagataatttgaattttttaaatgttaaagtatgaacattactaattgtttgttcagatttataaaacacagtacctattttgatgtgttaaaatgtaatcgggaaaataggaattttcccaagaaaaaaaaatacactaaaattttgatgtgttaaaatgtaataaatacaagtacctatttctttctacaacaggtatcacatgatctgctcaatctcattttgaaggcaaggtcgaaccctgtttgtaactaaatattttacaaatacactaaaagttttgttttgttttcctcatgcagaaaaaagaaaagaaagaagaagaaaaaaaactcacaaaaacatacattgttctacaatatgttaaagtaattgttctagggtaataaaatccgtgtctgcctcttccacttcaataggaaagtgtaagtttttcgaatctttttggccagataatttaaaaccgaccgaggaaacttacttttgtaaaagtgaccatttgcacataggaagtagaaagttgataattggaaaatttataatattttatacaaaagaagtgtttaagaaccaccgcttggtctcaccactcaaattcgaacgtatggctcgtgggcacaaactcctgtaccaacctttagatactagcggcacgaggagacttctattttctctttgtttttaagtttttttatcgacttaaatatggctttttgcaccatttaatttcaaaaccaatgtctttctctcgaggaactttgtttttatttcttagaagatgaggggagatttactatctaaataaaattttaaatgtttgtaagtattatgagctcaacaattttgtcaatagtgccacaaatttaaacgtttgctttttgtcttctttgaaaaatcaaatgctgaaaaactgttacatctctttttcttaaaaactcttgtctctctccttttccttctgctgaggtaattgaatgctgcaaagagaaagagaataacttaaacccaaaattacacttaccgccagaaaaaaaaaagagttcagtttaatctaacatattttatacaatacaattgaattatattagtaaaaaaaaaacttccatataaatcatggaacaaactggaacacatgggctctcttattttaatttattttcttttttgagggatttaaccatgtttattatatagttttataaatatatatataccatctctccataatttataaaatgaaagaaagagagagtcttcttgttggagtaaacccaaacggttttagattacttattagctgttcatcagttcttcctctctaaaagagtaaaacctaaacatctctctctgttctattagaaccaaagaccaatctttgtgaacaaaacacatctcgtatacttcagatctagactcgaaaattttagacctctttacaattggtctttgttcatctgaagttggagaaaatagttagcttaggtcggatcttttcatatgctttggatcctccttcgtctcttttgtataattttaaccttatcaagagttctttttgaatctcaaaagattatatagtagtatagaaggtttatatgtatatgtatagccagatagtttatgttgtttaaagattcgatgatagccaagttgggttaactttctttttccttgcctccttactcacatacaaaccctatctgtccgtacaaaatactaaaaaccctaacttt

SEQ ID NO: 10454 - DNA, 1700 bp, Arabidopsis (AT1G69120) APETALA 1
ttagactgatttctctatacactatcttttaacttatgtatcgtttcaaaactcaggacgtacatgtttaaatttggttatataaccacgaccatttcaagtatatatgtcataccataccagatttaatataacttctatgaagaaaatacataaagttggattaaaatgcaagtgacatctttttagcataggttcatttggcatagaagaaatatataactaaaaatgaactttaacttaaatagattttactatattacaattttttctttttacatggtctaatttatttttctaaaattagtataattgttgttttgatgaaacaataataccgtaagcaatagttgctaaaagatgtccaaatatttataaattacaaagtaaatcaaataaggaagaagacacgtggaaaacaccaaataagagaagaaatggaaaaaacagaaagaaattttttaacaagaaaaatcaattagtcctcaaacctgagatatttaaagtaatcaactaaaacaggaacacttgactaacaaagaaatttgaaacgtggtccaactttcacttaattatattgttttctctaaggcttatgcaatatatgccttaagcaaatgccgaatctgttttttttttttttgttattggatattgactgaaaataaggggttttttcacacttgaagatctcaaaagagaaaactattacaacggaaattcattgtaaaagaagtgattaagcaaattgagcaaaggtttttatgtggtttatttcattatatgattgacatcaaattgtatatatatggttgttttatttaacaatatatatggatataacgtacaaactaaatatgtttgattgacgaaaaaaaatatatgtatgtttgattaacaacatagcacatattcaactgatttttgtcctgatcatctacaacttaataagaacacacaacattgaacaaatctttgacaaaatactatttttgggtttgaaattttgaatacttacaattattcttctcgatcttcctctctttccttaaatcctgcgtacaaatccgtcgacgcaatacattacacagttgtcaattggttctcagctctaccaaaaacatctattgccaaaagaaaggtctatttgtacttcactgttacagctgagaacattaaatataataagcaaatttgataaaacaaagggttctcaccttattccaaaagaatagtgtaaaatagggtaatagagaaatgttaataaaaggaaattaaaaatagatattttggttggttcagattttgtttcgtagatctacagggaaatctccgccgtcaatgcaaagcgaaggtgacacttggggaaggaccagtggtccgtacaatgttacttacccatttctcttcacgagacgtcgataatcaaattgtttattttcatatttttaagtccgcagttttattaaaaaatcatggacccgacattagtacgagatataccaatgagaagtcgacacgcaaatcctaaagaaaccactgtggtttttgcaaacaagagaaaccagctttagcttttccctaaaaccactcttacccaaatctctccataaataaagatcccgagactcaaacacaagtctttttataaaggaaagaaagaaaaactttcctaattggttcataccaaagtctgagct

SEQ ID NO: 10455 - DNA, 1096 bp, RootP Promoter
tcagatgaagaaggcggcttttgcacgatttcataatggctacgtatttggcagataaagttattgtgtatgaaggagaaccttccgtggattgcacggcatcttctcctcagtctctacgtagtggaatgaatttgttcttgtctcgtttgaacatcactttcagacgagatcctacgaatttcagaccaagaatcaataaactcgattcgatgaaggatagtgaccagaagcttgcgggatgttattactacttggatgattaagagagagatgacattgagagaatctttcaccggagaaaacctgaagtagtgagaaactcacgttttgatctttcctagccccttcaatctattataagatctcttgaattttattagatccatctggagtttaatttttgagaatatattatggtgtttgaattcggtttgtttcaatcgttcccatatattagactagtttttttcttcacacatgagaatctcaaaccgattgcgtagaagaagaactcgcattcatctgtttttgtctttagttgagaatgaatgaccgttgtaatgtcatgggcttcttttggtttgggtctgaatcacttaagcccaacacaatctcttcttaggttgaaacactgttgtttttgctgttttgtctgacacaaggcatcggatgatgtcgattgtcgaatatgcttcctcattcggagtgttctcagacatcttgagcttctcattagttaggcggtgcgctcgaaagtcgaagccgtgttgacatatcaaaacattgggaccattcaattttgtacaaatgtccaaacattatttcggtttgataacaataaacaaataaagaaagagttttttattggattcacttggcaacagccaacaacgaatcaaataatctatatacataattatattagaagctgtgaatgtgcctccgagtagacaaaagcacatgcaccataaatgatcaaacccatgaaacttccatctctctttttcccctatataaactaatgtcacttacctcaatattccatcaacaatatacatctgagatatcaaaactcctagagagatctaataaa

SEQ ID NO: 10456 - DNA, 2432 bp, arabidopsis ATTPS-CIN (AT3G25820) Promoter
atgtcaattttcatggcacatcgaggagaaactgtttccttgtggtaatcctttataatctctgttgctaggaggagatttttcattaatagtctatctttcacaaaggcagattgatttgaagagatgaacttgggaagaatgattttgagtctgtttgcaagaatcttcgatatcaccttatagagaacattacagcatgatatcggtctatagtccttcatcatcacagcttcttttctcttgggtatcaaggccaaaatagtggagtttactcctttgggtaggaagcctgtcttaaaaaaagattggatggctaccacaaaatcgtttcctactatcgaccatgtctcgttaaagaactcacaagtatatccgtcagggcctggggatttatttgaaggcattgagaagagaactttccgcacctcctctgcagtgacttctagtgtgagcttgtcttgtcattctcatcacatctataatccagtagagtttccagttcctcccgcgaccaatccacgtagtctggcggtttgagcgttaaaaagtctctgaagtatcgaactgcctctgcttttatttgctgctgatttgatgcaatatgtccatcatcacacttaatctctctaacattgttacgaacctcccgaatctttgcagcattgtagaaagttttattattttggtctcctatcttcatccaatgcagttttgctttttgcctaaggtagctttcctcaatacccgacagccttaaccacttctcatatgcgtccgcttcagctaccactgcctgtgaagatggccttgtcatagtttctgcttgcttttcacataaagttttataggcttcttttgctttttttgagatatcaccaagtaactgcttccccatctttctgaaatgtggcttcagaccttttaatttttttgataagcggtgcatggctgaggtagaatgaaagagaggctgagttgtcttccaaagctcttctgtctcacttctgaaatccgaatacgaaattaaagcatttataaatttaaaaggcctcttgactcgttgttcctgctccataatatagaatcgacatcttaggtgatctgaacaaccgcctgattcaaagacgctgtaggactgttcatactattgcatccattgcttgctaatcagtaccctatccagcttcttacatattactccttcctttctcttgttacaccatgtgtatctctggccttggtagctcatatctgttaattcacaatgtctgattaagtcttgaaaatctctcatcccttggagaacgaatggagatgattcatagagtgaatggtcctctccttctaatatctcattaaagtctccacatattaaccaagctttgttatagaacaaaggggaatcatgatgatatttaatatcactccacaaatcctttctttctgctgcaaaatttgatgcataaacaaacgacacaaagaactcttcttgtcttccttctaataagacagagcaagtgatgagttgtgacgtcttatatattggagatacacgcacgttatcttctattatctttcaatagtaatttgatataaattaagataatgtgcagtgaacgagtggcgattgttaagccaagtgaacattatatactttattttatactttctccaagcttcgaatggagaatttatttccatacgactaactctacctaaaagggccatgtttgtttgccaacataacacgacgatcacgagatacacataacatttagaatttggagaagatacattttgtttgacttcactttttgtgcgaatggctgttctacctgaaggggccattagtataatttttttgtacataataacgtcaccaaatataacacgagaatcacgaggtacacaaatcatttaggcttggacattatctaatcaaataagctatgatatcaaatttacatacatatagtggcctcgtgggtataattacacaaggagcttttggagaaaaagaagtgtgtgatttaaatgacaattatacaaatgtgtacaattatcagatccaaagttcatgttttaaatcatcaaaaaaataataattgatgagttaaatgatatttttttcatttagatttagttagattagttgtacggttgtaccattatttaataatttaaaagttgaaatgattataatgtataaaagttgaaaatattgtaacagatatagattaagcatttttgcggtcaatatattataaaagcttttttagctattaattgaaaaatattttacacccttagatcttttgatctcctaattatataaaatattttcttctaccgtttgtctatataaccatatgtgttgtctagtgcatgtattcagccacgaataagagaatagtctactaaatcaatgg

SEQ ID NO: 10457 - DNA, 277 bp, NOS TERMINATOR
gagctcgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattc

SEQ ID NO: 10458 - DNA, 31 bp, Artificial Sequence
  PRIMER
aaaaggcctaaacctagcaattcacagcacc

SEQ ID NO: 10459 - DNA, 31 bp, Artificial Sequence
  PRIMER
aaaaggcctaactaagggagagaacccagag

SEQ ID NO: 10460 - DNA, 31 bp, Artificial Sequence
  PRIMER
aaaaggcctaattcgcaatagtctttcggtg

SEQ ID NO: 10461 - DNA, 31 bp, Artificial Sequence
  PRIMER
aaaaggcctaccctcaacaaagcatgtatcc

SEQ ID NO: 10462 - DNA, 31 bp, Artificial Sequence
  PRIMER
aaaaggcctaccttcaaacaagctcacaagc

SEQ ID NO: 10463 - DNA, 30 bp, Artificial Sequence
  PRIMER
aaaaggcctacggagcacctatttgctttc

SEQ ID NO: 10464 - DNA, 31 bp, Artificial Sequence
  PRIMER
aaaaggcctacgttatccaagatggcatcag

SEQ ID NO: 10465 - DNA, 31 bp, Artificial Sequence
  PRIMER
aaaaggcctagggcatcatcttagagcattg

SEQ ID NO: 10466 - DNA, 31 bp, Artificial Sequence
  PRIMER
aaaaggcctatatccggatccattcctaacc

SEQ ID NO: 10467 - DNA, 31 bp, Artificial Sequence
  PRIMER
aaaaggcctattccctgatggaaacagtaag

SEQ ID NO: 10468 - DNA, 30 bp, Artificial Sequence
  PRIMER
aaaaggcctcagttggagcaggtagcagag

SEQ ID NO: 10469 - DNA, 28 bp, Artificial Sequence
  PRIMER
aaaaggcctccatggtgaacggtacagg

SEQ ID NO: 10470 - DNA, 35 bp, Artificial Sequence
  PRIMER
aaaaggcctctacaaccaaccaaccttagaatatg

SEQ ID NO: 10471 - DNA, 34 bp, Artificial Sequence
  PRIMER
aaaaggcctctacctagaatgcacacaacaaatc

SEQ ID NO: 10472 - DNA, 34 bp, Artificial Sequence
  PRIMER
aaaaggcctctatatgcacagacaaccagaaagc

SEQ ID NO: 10473 - DNA, 31 bp, Artificial Sequence
  PRIMER
aaaaggcctgaccagcccaacaaatgtttac

SEQ ID NO: 10474 - DNA, 31 bp, Artificial Sequence
  PRIMER
aaaaggcctgactgcttcatttcaaacgctc

SEQ ID NO: 10475 - DNA, 33 bp, Artificial Sequence
  PRIMER
aaaaggcctgcagggcaattacattagatatgg

SEQ ID NO: 10476 - DNA, 30 bp, Artificial Sequence
  PRIMER
aaaaggcctgcattgcaccacagaataagg

SEQ ID NO: 10477 - DNA, 31 bp, Artificial Sequence
  PRIMER
aaaaggccttagacactaaagcgaaccaacg

SEQ ID NO: 10478 - DNA, 35 bp, Artificial Sequence
  PRIMER
aaaaggccttcactcagaaagtcaatggctcttgt

SEQ ID NO: 10479 - DNA, 31 bp, Artificial Sequence
  PRIMER
aaaaggcctttcagaacaaggtcagtgcaag

SEQ ID NO: 10480 - DNA, 31 bp, Artificial Sequence
  PRIMER
aaaaggcctttgcatcactagagcactcgac

SEQ ID NO: 10481 - DNA, 32 bp, Artificial Sequence
  PRIMER
aaacccgggcctagttttcgaaatcctccgag

SEQ ID NO: 10482 - DNA, 28 bp, Artificial Sequence
  PRIMER
aaacccggggccatttcgctcgtctctc

SEQ ID NO: 10483 - DNA, 26 bp, Artificial Sequence
  PRIMER
aaacccgggtcgccaagatgctgcag

SEQ ID NO: 10484 - DNA, 31 bp, Artificial Sequence
  PRIMER
aaactcgagacacagacatacatgggatcct

SEQ ID NO: 10485 - DNA, 26 bp, Artificial Sequence
  PRIMER
aaactcgagacgccatggtgatccct

SEQ ID NO: 10486 - DNA, 31 bp, Artificial Sequence
  PRIMER
aaactcgagagacttagcgttcttggtggtg

SEQ ID NO: 10487 - DNA, 30 bp, Artificial Sequence
  PRIMER
aaactcgagagagagaaagacaagcggtgg

SEQ ID NO: 10488 - DNA, 26 bp, Artificial Sequence
  PRIMER
aaactcgagagctgcgacgtctccct

SEQ ID NO: 10489 - DNA, 31 bp, Artificial Sequence
  PRIMER
aaactcgagattcttcagtcgtccctctgtc

SEQ ID NO: 10490 - DNA, 29 bp, Artificial Sequence
  PRIMER
aaactcgagcaaagcttgaccaaccatgg

SEQ ID NO: 10491 - DNA, 31 bp, Artificial Sequence
  PRIMER
aaactcgagcaaggcatcaaccatcaatatc

SEQ ID NO: 10492 - DNA, 28 bp, Artificial Sequence
  PRIMER
aaactcgagcacttcctccctccaatcc

SEQ ID NO: 10493 - DNA, 27 bp, Artificial Sequence
  PRIMER
aaactcgagccttcaaatcccatggcc

SEQ ID NO: 10494 - DNA, 27 bp, Artificial Sequence
  PRIMER
aaactcgaggaaactttggcgcccttc

SEQ ID NO: 10495 - DNA, 26 bp, Artificial Sequence
  PRIMER
aaactcgaggacgcgaacccaggatc

SEQ ID NO: 10496 - DNA, 28 bp, Artificial Sequence
  PRIMER
aaactcgaggatgagaggaggcgatgag

SEQ ID NO: 10497 - DNA, 29 bp, Artificial Sequence
  PRIMER
aaactcgagtcggcttctccttctccttc

SEQ ID NO: 10498 - DNA, 27 bp, Artificial Sequence
  PRIMER
aaactcgagtgcagctgagtgctgacc

SEQ ID NO: 10499 - DNA, 31 bp, Artificial Sequence
  PRIMER
aaactcgagtgtagatctagcagcagcaatg

SEQ ID NO: 10500 - DNA, 26 bp, Artificial Sequence
  PRIMER
aaactcgagttgggcgatggagaagg

SEQ ID NO: 10501 - DNA, 31 bp, Artificial Sequence
  PRIMER
aaagaattcaaacgagctggaatatgaccac

SEQ ID NO: 10502 - DNA, 31 bp, Artificial Sequence
  PRIMER
aaagaattcaaactgctcactccaacctctc

SEQ ID NO: 10503 - DNA, 30 bp, Artificial Sequence
  PRIMER
aaagaattcaaagattccacgacttgggac

SEQ ID NO: 10504 - DNA, 31 bp, Artificial Sequence
  PRIMER
aaagaattcaaaggctggttacacaagagac

SEQ ID NO: 10505 - DNA, 31 bp, Artificial Sequence
  PRIMER
aaagaattcaacatcgaagaacacaagcctc

SEQ ID NO: 10506 - DNA, 31 bp, Artificial Sequence
  PRIMER
aaagaattcaagccaattactccgtgtgttc

SEQ ID NO: 10507 - DNA, 27 bp, Artificial Sequence
  PRIMER
aaagaattcaaggggacgtaggaggcg

SEQ ID NO: 10508 - DNA, 31 bp, Artificial Sequence
  PRIMER
aaagaattcaaggttacactaggagccgagc

SEQ ID NO: 10509 - DNA, 31 bp, Artificial Sequence
  PRIMER
aaagaattcaattaacagcgaggaaatcacg

SEQ ID NO: 10510 - DNA, 30 bp, Artificial Sequence
  PRIMER
aaagaattcactcacctaaaggctgaaagc

SEQ ID NO: 10511 - DNA, 31 bp, Artificial Sequence
  PRIMER
aaagaattcactcgctcttcttcctccaaac

SEQ ID NO: 10512 - DNA, 31 bp, Artificial Sequence
  PRIMER
aaagaattcactgacaacaacaagctcatcg

SEQ ID NO: 10513 - DNA, 31 bp, Artificial Sequence
  PRIMER
aaagaattcagaagaagatggtggctgtgac

SEQ ID NO: 10514 - DNA, 31 bp, Artificial Sequence
  PRIMER
aaagaattcagaatcaatggttccactctgc

SEQ ID NO: 10515 - DNA, 29 bp, Artificial Sequence
  PRIMER
aaagaattcagcaacagctagcgcacatc

SEQ ID NO: 10516 - DNA, 31 bp, Artificial Sequence
  PRIMER
aaagaattcaggagtggaatggcttattcag

SEQ ID NO: 10517 - DNA, 31 bp, Artificial Sequence
  PRIMER
aaagaattcaggtcgcacggtacctaagaag

SEQ ID NO: 10518 - DNA, 30 bp, Artificial Sequence
  PRIMER
aaagaattcaggtggtcgctgtagagaatg

SEQ ID NO: 10519 - DNA, 31 bp, Artificial Sequence
  PRIMER
aaagaattcagtcccaagcaatctcagactc

SEQ ID NO: 10520 - DNA, 31 bp, Artificial Sequence
  PRIMER
aaagaattcatacatcaccgtcgcactacac

SEQ ID NO: 10521 - DNA, 31 bp, Artificial Sequence
  PRIMER
aaagaattcatacgatgcgtcttccttcaac

SEQ ID NO: 10522 - DNA, 29 bp, Artificial Sequence
  PRIMER
aaagaattcatccacacgaagttgcaaag

SEQ ID NO: 10523 - DNA, 31 bp, Artificial Sequence
  PRIMER
aaagaattcatcggtaacaagacactggaag

SEQ ID NO: 10524 - DNA, 32 bp, Artificial Sequence
  PRIMER
aaagaattccaacgtcaggcagattacatacc

SEQ ID NO: 10525 - DNA, 31 bp, Artificial Sequence
  PRIMER
aaagaattccatatgccaaagcagacatgag

SEQ ID NO: 10526 - DNA, 30 bp, Artificial Sequence
  PRIMER
aaagaattccatgtcgcgtgttcttcatag

SEQ ID NO: 10527 - DNA, 27 bp, Artificial Sequence
  PRIMER
aaagaattccctagcttgccaccctcc

SEQ ID NO: 10528 - DNA, 31 bp, Artificial Sequence
  PRIMER
aaagaattccctaggtattccttctccgtgg

SEQ ID NO: 10529 - DNA, 31 bp, Artificial Sequence
  PRIMER
aaagaattccgaaatcatcatggttgagatg

SEQ ID NO: 10530 - DNA, 26 bp, Artificial Sequence
  PRIMER
aaagaattccggcaatggaggtcacc

SEQ ID NO: 10531 - DNA, 32 bp, Artificial Sequence
  PRIMER
aaagaattccgtgttcttcatagatcgattcc

SEQ ID NO: 10532 - DNA, 29 bp, Artificial Sequence
  PRIMER
aaagaattcctaaatcatcaaggcggcag

SEQ ID NO: 10533 - DNA, 34 bp, Artificial Sequence
  PRIMER
aaagaattcctaacgtacgtggaaatgaacacac

SEQ ID NO: 10534 - DNA, 34 bp, Artificial Sequence
  PRIMER
aaagaattcctaataacaaacgcaacaaatctgc

SEQ ID NO: 10535 - DNA, 34 bp, Artificial Sequence
  PRIMER
aaagaattcctaatacacccacggacgtatgaac

SEQ ID NO: 10536 - DNA, 34 bp, Artificial Sequence
  PRIMER
aaagaattcctacaaggacaataatctcccatgc

SEQ ID NO: 10537 - DNA, 31 bp, Artificial Sequence
  PRIMER
aaagaattcctacctcactgccataaccgag

SEQ ID NO: 10538 - DNA, 36 bp, Artificial Sequence
  PRIMER
aaagaattcctagcaggaaaccataatcaaatcatc

SEQ ID NO: 10539 - DNA, 34 bp, Artificial Sequence
  PRIMER
aaagaattcctataacaatgaagatcgttccgag

SEQ ID NO: 10540 - DNA, 36 bp, Artificial Sequence
  PRIMER
aaagaattcctataacatgctaatacagcgaactgc

SEQ ID NO: 10541 - DNA, 31 bp, Artificial Sequence
  PRIMER
aaagaattcctccctctcttcttaccaatcg

SEQ ID NO: 10542 - DNA, 31 bp, Artificial Sequence
  PRIMER
aaagaattcctgcatttcattgttcaccatc

SEQ ID NO: 10543 - DNA, 34 bp, Artificial Sequence
  PRIMER
aaagaattcgactcggcatagtgctagtttattg

SEQ ID NO: 10544 - DNA, 31 bp, Artificial Sequence
  PRIMER
aaagaattcgacttgggacttctcacattcc

SEQ ID NO: 10545 - DNA, 34 bp, Artificial Sequence
  PRIMER
aaagaattcgaggatatacatccaaattcaatcc

SEQ ID NO: 10546 - DNA, 30 bp, Artificial Sequence
  PRIMER
aaagaattcgctactgaagcagcagcctac

SEQ ID NO: 10547 - DNA, 31 bp, Artificial Sequence
  PRIMER
aaagaattcggaacacctcattcctcaagtc

SEQ ID NO: 10548 - DNA, 31 bp, Artificial Sequence
  PRIMER
aaagaattcggtgcaatacattgctctgttc

SEQ ID NO: 10549 - DNA, 32 bp, Artificial Sequence
  PRIMER
aaagaattcgtattgcatctcctctctccctc

SEQ ID NO: 10550 - DNA, 31 bp, Artificial Sequence
  PRIMER
aaagaattcgtcccgactagagcagtctacc

SEQ ID NO: 10551 - DNA, 28 bp, Artificial Sequence
  PRIMER
aaagaattcgtttagcctcccgctgttg

SEQ ID NO: 10552 - DNA, 31 bp, Artificial Sequence
  PRIMER
aaagaattctacactcaaggtccacatccac

SEQ ID NO: 10553 - DNA, 31 bp, Artificial Sequence
  PRIMER
aaagaattctactgctccttcctttgtcctc

SEQ ID NO: 10554 - DNA, 31 bp, Artificial Sequence
  PRIMER
aaagaattctattgcagaagtccacacaagc

SEQ ID NO: 10555 - DNA, 32 bp, Artificial Sequence
  PRIMER
aaagaattctcaaattgtttaaatcctccttg

SEQ ID NO: 10556 - DNA, 30 bp, Artificial Sequence
  PRIMER
aaagaattctccagtgtcatgcaaggaaag

SEQ ID NO: 10557 - DNA, 31 bp, Artificial Sequence
  PRIMER
aaagaattctccgttctctcctatccaacac

SEQ ID NO: 10558 - DNA, 26 bp, Artificial Sequence
  PRIMER
aaagaattctcgttccttcgcgatgg

SEQ ID NO: 10559 - DNA, 31 bp, Artificial Sequence
  PRIMER
aaagaattctctcgaggagatgggttatttc

SEQ ID NO: 10560 - DNA, 31 bp, Artificial Sequence
  PRIMER
aaagaattctgagacgccactttatttcagc

SEQ ID NO: 10561 - DNA, 31 bp, Artificial Sequence
  PRIMER
aaagaattctgcacacgtgtatatagccagc

SEQ ID NO: 10562 - DNA, 32 bp, Artificial Sequence
  PRIMER
aaagaattctgtcagctacactatcactcacc

SEQ ID NO: 10563 - DNA, 31 bp, Artificial Sequence
  PRIMER
aaagaattcttaagttggcgtcagtagcaag

SEQ ID NO: 10564 - DNA, 31 bp, Artificial Sequence
  PRIMER
aaagaattcttgaaccaatgagcactgagac

SEQ ID NO: 10565 - DNA, 31 bp, Artificial Sequence
  PRIMER
aaagagctcacaagagttcacctttgcaacc

SEQ ID NO: 10566 - DNA, 26 bp, Artificial Sequence
  PRIMER
aaagagctcccgccatggataccctc

SEQ ID NO: 10567 - DNA, 31 bp, Artificial Sequence
  PRIMER
aaagagctcctccatcttattccatccttgg

SEQ ID NO: 10568 - DNA, 34 bp, Artificial Sequence
  PRIMER
aaagagctcgaccaaacaaactcctcactaaacc

SEQ ID NO: 10569 - DNA, 31 bp, Artificial Sequence
  PRIMER
aaagagctcgtacactttgggattctgcgtc

SEQ ID NO: 10570 - DNA, 31 bp, Artificial Sequence
  PRIMER
aaagagctctcctctcggctaccaatgttac

SEQ ID NO: 10571 - DNA, 27 bp, Artificial Sequence
  PRIMER
aaagatatcaggatcagcgatgccttc

SEQ ID NO: 10572 - DNA, 29 bp, Artificial Sequence
  PRIMER
aaagatatcgtggttcctaagggcgaatc

SEQ ID NO: 10573 - DNA, 31 bp, Artificial Sequence
  PRIMER
aaagatatcttacagcaagactggacgacac

SEQ ID NO: 10574 - DNA, 31 bp, Artificial Sequence
  PRIMER
aaagatatcttccttgaaacgatcttgaacc

SEQ ID NO: 10575 - DNA, 26 bp, Artificial Sequence
  PRIMER
aaaggatccaaaacccagctccggtc

SEQ ID NO: 10576 - DNA, 29 bp, Artificial Sequence
  PRIMER
aaaggatccaaacaatggtttcagcttcg

SEQ ID NO: 10577 - DNA, 32 bp, Artificial Sequence
  PRIMER
aaaggatccaaacctcattccaagctctcttc

SEQ ID NO: 10578 - DNA, 30 bp, Artificial Sequence
  PRIMER
aaaggatccaaactcttactcgcggagctg

SEQ ID NO: 10579 - DNA, 30 bp, Artificial Sequence
  PRIMER
aaaggatccaaactgaaatagcgaggaagg

SEQ ID NO: 10580 - DNA, 33 bp, Artificial Sequence
  PRIMER
aaaggatccaaacttattcaccaaagagaaacc

SEQ ID NO: 10581 - DNA, 31 bp, Artificial Sequence
  PRIMER
aaaggatccaaagaacaatggagaacgcaag

SEQ ID NO: 10582 - DNA, 27 bp, Artificial Sequence
  PRIMER
aaaggatccaaatgccacccaattctc

SEQ ID NO: 10583 - DNA, 30 bp, Artificial Sequence
  PRIMER
aaaggatccaaattcgagaaagagtgatcg

SEQ ID NO: 10584 - DNA, 32 bp, Artificial Sequence
  PRIMER
aaaggatccaacatctaaactatgatcgcagc

SEQ ID NO: 10585 - DNA, 30 bp, Artificial Sequence
  PRIMER
aaaggatccaaccctagagtctctcgcacg

SEQ ID NO: 10586 - DNA, 30 bp, Artificial Sequence
  PRIMER
aaaggatccaaccctagtaccatcaccgac

SEQ ID NO: 10587 - DNA, 29 bp, Artificial Sequence
  PRIMER
aaaggatccaactgaacggagcgagtagc

SEQ ID NO: 10588 - DNA, 35 bp, Artificial Sequence
  PRIMER
aaaggatccaagaaaatgtttaaattgctgtttct

SEQ ID NO: 10589 - DNA, 30 bp, Artificial Sequence
  PRIMER
aaaggatccaagaaatgggaggaggagaag

SEQ ID NO: 10590 - DNA, 33 bp, Artificial Sequence
  PRIMER
aaaggatccaagataacagaaagaaagggtttg

SEQ ID NO: 10591 - DNA, 27 bp, Artificial Sequence
  PRIMER
aaaggatccaagcgaacggacacgatg

SEQ ID NO: 10592 - DNA, 33 bp, Artificial Sequence
  PRIMER
aaaggatccaagctctcttcattggttcatagc

SEQ ID NO: 10593 - DNA, 27 bp, Artificial Sequence
  PRIMER
aaaggatccaagcttcctcctcccgtg

SEQ ID NO: 10594 - DNA, 31 bp, Artificial Sequence
  PRIMER
aaaggatccaaggaaggaagagctgaattgg

SEQ ID NO: 10595 - DNA, 31 bp, Artificial Sequence
  PRIMER
aaaggatccaaggacaaatccttcgtgtcag

SEQ ID NO: 10596 - DNA, 30 bp, Artificial Sequence
  PRIMER
aaaggatccaaggcgagctctatagccagg

SEQ ID NO: 10597 - DNA, 27 bp, Artificial Sequence
  PRIMER
aaaggatccaagggaatcgccatcagc

SEQ ID NO: 10598 - DNA, 31 bp, Artificial Sequence
  PRIMER
aaaggatccaatcatctttcatttcacgacc

SEQ ID NO: 10599 - DNA, 31 bp, Artificial Sequence
  PRIMER
aaaggatccaatccttatcctcccaaaccag

SEQ ID NO: 10600 - DNA, 30 bp, Artificial Sequence
  PRIMER
aaaggatccaattcctctctgccctagcac

SEQ ID NO: 10601 - DNA, 33 bp, Artificial Sequence
  PRIMER
aaaggatccaatttctagactctgctgtttgtg

SEQ ID NO: 10602 - DNA, 31 bp, Artificial Sequence
  PRIMER
aaaggatccacagattggcagattgatttcc

SEQ ID NO: 10603 - DNA, 31 bp, Artificial Sequence
  PRIMER
aaaggatccaccagctggctattctctcttg

SEQ ID NO: 10604 - DNA, 28 bp, Artificial Sequence
  PRIMER
aaaggatccacccaggtacacctacgcg

SEQ ID NO: 10605 - DNA, 28 bp, Artificial Sequence
  PRIMER
aaaggatccaccgtgatctgctctgctc

SEQ ID NO: 10606 - DNA, 31 bp, Artificial Sequence
  PRIMER
aaaggatccaccttgcaggattatcgatctg

SEQ ID NO: 10607 - DNA, 31 bp, Artificial Sequence
  PRIMER
aaaggatccacggagaccattaacgagactg

SEQ ID NO: 10608 - DNA, 31 bp, Artificial Sequence
  PRIMER
aaaggatccactacatgatcgtgaagccagc

SEQ ID NO: 10609 - DNA, 31 bp, Artificial Sequence
  PRIMER
aaaggatccactctgcgcttaaatcctttcc

SEQ ID NO: 10610 - DNA, 31 bp, Artificial Sequence
  PRIMER
aaaggatccacttgacactcctgtcctgctc

SEQ ID NO: 10611 - DNA, 27 bp, Artificial Sequence
  PRIMER
aaaggatccactttcagccatggccac

SEQ ID NO: 10612 - DNA, 31 bp, Artificial Sequence
  PRIMER
aaaggatccagaaggtaaaggtaaggcgacg

SEQ ID NO: 10613 - DNA, 30 bp, Artificial Sequence
  PRIMER
aaaggatccagaagttgagcggactgactg

SEQ ID NO: 10614 - DNA, 31 bp, Artificial Sequence
  PRIMER
aaaggatccagacacgagctctctcttcctg

SEQ ID NO: 10615 - DNA, 27 bp, Artificial Sequence
  PRIMER
aaaggatccagacgcctccccagtctc

SEQ ID NO: 10616 - DNA, 30 bp, Artificial Sequence
  PRIMER
aaaggatccagagagagacttcctcgcctc

SEQ ID NO: 10617 - DNA, 30 bp, Artificial Sequence
  PRIMER
aaaggatccagatctaaatttgacgccgac

SEQ ID NO: 10618 - DNA, 28 bp, Artificial Sequence
  PRIMER
aaaggatccagcagtccatcaccggttc

SEQ ID NO: 10619 - DNA, 28 bp, Artificial Sequence
  PRIMER
aaaggatccagcggcttcctctcttctg

SEQ ID NO: 10620 - DNA, 28 bp, Artificial Sequence
  PRIMER
aaaggatccagctcgatcgctccacttc

SEQ ID NO: 10621 - DNA, 36 bp, Artificial Sequence
  PRIMER
aaaggatccaggaaaaaaatgttatcttctacctcc

SEQ ID NO: 10622 - DNA, 31 bp, Artificial Sequence
  PRIMER
aaaggatccaggcagcaaactttcactaaac

SEQ ID NO: 10623 - DNA, 30 bp, Artificial Sequence
  PRIMER
aaaggatccagtacaccactagcgcagcag

SEQ ID NO: 10624 - DNA, 31 bp, Artificial Sequence
  PRIMER
aaaggatccagtatccgttcatcagcgtgag

SEQ ID NO: 10625 - DNA, 31 bp, Artificial Sequence
  PRIMER
aaaggatccagttcccagctcccatataacc

SEQ ID NO: 10626 - DNA, 31 bp, Artificial Sequence
  PRIMER
aaaggatccatagctgattggtgagggtctg

SEQ ID NO: 10627 - DNA, 31 bp, Artificial Sequence
  PRIMER
aaaggatccatatcacagtgcacacccactc

SEQ ID NO: 10628 - DNA, 28 bp, Artificial Sequence
  PRIMER
aaaggatccatccaccttccgtcagagc

SEQ ID NO: 10629 - DNA, 26 bp, Artificial Sequence
  PRIMER
aaaggatccatcgccatggccaccac

SEQ ID NO: 10630 - DNA, 30 bp, Artificial Sequence
  PRIMER
aaaggatccatcgtcggagcagagagagac

SEQ ID NO: 10631 - DNA, 31 bp, Artificial Sequence
  PRIMER
aaaggatccatctcctgaagcagaacatcac

SEQ ID NO: 10632 - DNA, 31 bp, Artificial Sequence
  PRIMER
aaaggatccatctctgaactcaggcatcctc

SEQ ID NO: 10633 - DNA, 27 bp, Artificial Sequence
  PRIMER
aaaggatccatgtcatgtggcccctct

SEQ ID NO: 10634 - DNA, 28 bp, Artificial Sequence
  PRIMER
aaaggatccatttcccaaacccaccctc

SEQ ID NO: 10635 - DNA, 26 bp, Artificial Sequence
  PRIMER
aaaggatcccaaaagccaccgcaagc

SEQ ID NO: 10636 - DNA, 31 bp, Artificial Sequence
  PRIMER
aaaggatcccaaatcatgagcttcacattca

SEQ ID NO: 10637 - DNA, 29 bp, Artificial Sequence
  PRIMER
aaaggatcccaaccaatcttcctcgttcc

SEQ ID NO: 10638 - DNA, 32 bp, Artificial Sequence
  PRIMER
aaaggatcccaagcttagtcaaagtgtctgtg

SEQ ID NO: 10639 - DNA, 31 bp, Artificial Sequence
  PRIMER
aaaggatcccacaacatactttcctccggtc

SEQ ID NO: 10640 - DNA, 31 bp, Artificial Sequence
  PRIMER
aaaggatcccaccaagtacttcatcaggcag

SEQ ID NO: 10641 - DNA, 31 bp, Artificial Sequence
  PRIMER
aaaggatcccaccaccctgtcatagtgtctc

SEQ ID NO: 10642 - DNA, 26 bp, Artificial Sequence
  PRIMER
aaaggatcccactcatcagcttcgcg

SEQ ID NO: 10643 - DNA, 28 bp, Artificial Sequence
  PRIMER
aaaggatcccagatccaccctcgcctag

SEQ ID NO: 10644 - DNA, 31 bp, Artificial Sequence
  PRIMER
aaaggatcccagcaagcattccacaacatac

SEQ ID NO: 10645 - DNA, 29 bp, Artificial Sequence
  PRIMER
aaaggatcccagccagccactctcatttc

SEQ ID NO: 10646 - DNA, 29 bp, Artificial Sequence
  PRIMER
aaaggatcccagccatgtcttccgtcttc

SEQ ID NO: 10647 - DNA, 31 bp, Artificial Sequence
  PRIMER
aaaggatcccatagcttgccagtttctgatg

SEQ ID NO: 10648 - DNA, 26 bp, Artificial Sequence
  PRIMER
aaaggatcccatcaccggttccgttc

SEQ ID NO: 10649 - DNA, 31 bp, Artificial Sequence
  PRIMER
aaaggatcccatccagatcactaaacggcag

SEQ ID NO: 10650 - DNA, 31 bp, Artificial Sequence
  PRIMER
aaaggatcccatcttgtgatggccaattaac

SEQ ID NO: 10651 - DNA, 31 bp, Artificial Sequence
  PRIMER
aaaggatcccatgcatccagatcactaaacg

SEQ ID NO: 10652 - DNA, 31 bp, Artificial Sequence
  PRIMER
aaaggatcccatgtctccaaccttgtgactc

SEQ ID NO: 10653 - DNA, 32 bp, Artificial Sequence
  PRIMER
aaaggatcccatttcgtgctttaccagttatc

SEQ ID NO: 10654 - DNA, 31 bp, Artificial Sequence
  PRIMER
aaaggatccccaaataaaccctaaaccctgc

SEQ ID NO: 10655 - DNA, 29 bp, Artificial Sequence
  PRIMER
aaaggatccccaaccaatcttcctcgttc

SEQ ID NO: 10656 - DNA, 31 bp, Artificial Sequence
  PRIMER
aaaggatccccaactttcttgatctttgacc

SEQ ID NO: 10657 - DNA, 29 bp, Artificial Sequence
  PRIMER
aaaggatcccccaaactcaaatcatgagc

SEQ ID NO: 10658 - DNA, 31 bp, Artificial Sequence
  PRIMER
aaaggatccccgagtagggctgatacagttc

SEQ ID NO: 10659 - DNA, 28 bp, Artificial Sequence
  PRIMER
aaaggatccccgatacgaatccgacgag

SEQ ID NO: 10660 - DNA, 30 bp, Artificial Sequence
  PRIMER
aaaggatccccgccacggaacttaatacac

SEQ ID NO: 10661 - DNA, 32 bp, Artificial Sequence
  PRIMER
aaaggatccccgtataatctcctttgtcctcc

SEQ ID NO: 10662 - DNA, 31 bp, Artificial Sequence
  PRIMER
aaaggatcccctaccttcacttcacacaaag

SEQ ID NO: 10663 - DNA, 31 bp, Artificial Sequence
  PRIMER
aaaggatcccctctgtaggcagatcagtgtg

SEQ ID NO: 10664 - DNA, 31 bp, Artificial Sequence
  PRIMER
aaaggatccccttgaacatacaatcagcaag

SEQ ID NO: 10665 - DNA, 31 bp, Artificial Sequence
  PRIMER
aaaggatcccgaacgacactgtacacaaacc

SEQ ID NO: 10666 - DNA, 30 bp, Artificial Sequence
  PRIMER
aaaggatcccgaccagagtgaatttggaag

SEQ ID NO: 10667 - DNA, 27 bp, Artificial Sequence
  PRIMER
aaaggatcccgactgcctgttcttccc

SEQ ID NO: 10668 - DNA, 32 bp, Artificial Sequence
  PRIMER
aaaggatcccgagattgttgaattcctctctg

SEQ ID NO: 10669 - DNA, 32 bp, Artificial Sequence
  PRIMER
aaaggatcccgcaagagaagaatagaaaatgg

SEQ ID NO: 10670 - DNA, 26 bp, Artificial Sequence
  PRIMER
aaaggatcccgcttcagatggccgag

SEQ ID NO: 10671 - DNA, 30 bp, Artificial Sequence
  PRIMER
aaaggatcccggatcaacagtttcaatctc

SEQ ID NO: 10672 - DNA, 31 bp, Artificial Sequence
  PRIMER
aaaggatcccgtatctcagctcctccacttc

SEQ ID NO: 10673 - DNA, 28 bp, Artificial Sequence
  PRIMER
aaaggatcccgtctgaattcgcaaaacc

SEQ ID NO: 10674 - DNA, 33 bp, Artificial Sequence
  PRIMER
aaaggatccctaaaagagcagcctcaaccacac

SEQ ID NO: 10675 - DNA, 35 bp, Artificial Sequence
  PRIMER
aaaggatccctaatggcagttgatttcatcacaag

SEQ ID NO: 10676 - DNA, 35 bp, Artificial Sequence
  PRIMER
aaaggatccctaatttactgctactctgctgcctc

SEQ ID NO: 10677 - DNA, 29 bp, Artificial Sequence
  PRIMER
aaaggatccctacgcctcccgtagacaac

SEQ ID NO: 10678 - DNA, 31 bp, Artificial Sequence
  PRIMER
aaaggatccctagctcagcacgtcaagatcc

SEQ ID NO: 10679 - DNA, 33 bp, Artificial Sequence
  PRIMER
aaaggatccctatactgctactctgctgcctcc

SEQ ID NO: 10680 - DNA, 31 bp, Artificial Sequence
  PRIMER
aaaggatccctatccacttagccgaccagag

SEQ ID NO: 10681 - DNA, 29 bp, Artificial Sequence
  PRIMER
aaaggatccctcccagatcccaatttgtc

SEQ ID NO: 10682 - DNA, 27 bp, Artificial Sequence
  PRIMER
aaaggatccctccccagtctccacctc

SEQ ID NO: 10683 - DNA, 31 bp, Artificial Sequence
  PRIMER
aaaggatccctcctcagctttaagcatcctc

SEQ ID NO: 10684 - DNA, 33 bp, Artificial Sequence
  PRIMER
aaaggatccctctctcctcagctttaagcatcc

SEQ ID NO: 10685 - DNA, 31 bp, Artificial Sequence
  PRIMER
aaaggatccctgcaacactcgctacaaaatg

SEQ ID NO: 10686 - DNA, 29 bp, Artificial Sequence
  PRIMER
aaaggatccctgcaagcgcgagaagttag

SEQ ID NO: 10687 - DNA, 31 bp, Artificial Sequence
  PRIMER
aaaggatccctgtctctcgatcctgcatctc

SEQ ID NO: 10688 - DNA, 30 bp, Artificial Sequence
  PRIMER
aaaggatccctgtgagcagtggtaccaagg

SEQ ID NO: 10689 - DNA, 28 bp, Artificial Sequence
  PRIMER
aaaggatcccttccgtgaaaatgaggtg

SEQ ID NO: 10690 - DNA, 28 bp, Artificial Sequence
  PRIMER
aaaggatcccttcgctctctccgtttcc

SEQ ID NO: 10691 - DNA, 30 bp, Artificial Sequence
  PRIMER
aaaggatcccttgagaagaaccacacacac

SEQ ID NO: 10692 - DNA, 30 bp, Artificial Sequence
  PRIMER
aaaggatcccttgccattctcatagcttgc

SEQ ID NO: 10693 - DNA, 31 bp, Artificial Sequence
  PRIMER
aaaggatcccttgtgactcgatccgatcttc

SEQ ID NO: 10694 - DNA, 29 bp, Artificial Sequence
  PRIMER
aaaggatccctttccaattgaccagtcgc

SEQ ID NO: 10695 - DNA, 34 bp, Artificial Sequence
  PRIMER
aaaggatccgaaagaatcaagcttagtcaaagtg

SEQ ID NO: 10696 - DNA, 28 bp, Artificial Sequence
  PRIMER
aaaggatccgaaaggagtaggcccaatg

SEQ ID NO: 10697 - DNA, 28 bp, Artificial Sequence
  PRIMER
aaaggatccgaaatagcgaggaagggac

SEQ ID NO: 10698 - DNA, 27 bp, Artificial Sequence
  PRIMER
aaaggatccgacaccggtgattccgtg

SEQ ID NO: 10699 - DNA, 29 bp, Artificial Sequence
  PRIMER
aaaggatccgaccactcgagagctccaac

SEQ ID NO: 10700 - DNA, 31 bp, Artificial Sequence
  PRIMER
aaaggatccgacctggtttagtggagtggtg

SEQ ID NO: 10701 - DNA, 34 bp, Artificial Sequence
  PRIMER
aaaggatccgacgactttctagtctctctcctcc

SEQ ID NO: 10702 - DNA, 29 bp, Artificial Sequence
  PRIMER
aaaggatccgagagcagttgcgcactagc

SEQ ID NO: 10703 - DNA, 32 bp, Artificial Sequence
  PRIMER
aaaggatccgagatcctctgctactcacttgc

SEQ ID NO: 10704 - DNA, 29 bp, Artificial Sequence
  PRIMER
aaaggatccgagcagtgcttgaaaccagc

SEQ ID NO: 10705 - DNA, 31 bp, Artificial Sequence
  PRIMER
aaaggatccgagcattccaccactttgctac

SEQ ID NO: 10706 - DNA, 26 bp, Artificial Sequence
  PRIMER
aaaggatccgagcgacgcgaccactc

SEQ ID NO: 10707 - DNA, 26 bp, Artificial Sequence
  PRIMER
aaaggatccgaggcgactgcgagctc

SEQ ID NO: 10708 - DNA, 34 bp, Artificial Sequence
  PRIMER
aaaggatccgatatctagagtggagaggtttgag

SEQ ID NO: 10709 - DNA, 28 bp, Artificial Sequence
  PRIMER
aaaggatccgattccccactcgctcatc

SEQ ID NO: 10710 - DNA, 31 bp, Artificial Sequence
  PRIMER
aaaggatccgatttcgaacgagaaatgaagc

SEQ ID NO: 10711 - DNA, 28 bp, Artificial Sequence
  PRIMER
aaaggatccgcaaaatgttggggagaag

SEQ ID NO: 10712 - DNA, 30 bp, Artificial Sequence
  PRIMER
aaaggatccgcaatcagctcatctgtcagc

SEQ ID NO: 10713 - DNA, 27 bp, Artificial Sequence
  PRIMER
aaaggatccgcaccaaaaggagcatgg

SEQ ID NO: 10714 - DNA, 28 bp, Artificial Sequence
  PRIMER
aaaggatccgcaggcgaaaaccctactc

SEQ ID NO: 10715 - DNA, 30 bp, Artificial Sequence
  PRIMER
aaaggatccgccaacactgaatttcatagc

SEQ ID NO: 10716 - DNA, 31 bp, Artificial Sequence
  PRIMER
aaaggatccgccaactggagtagtagccaac

SEQ ID NO: 10717 - DNA, 27 bp, Artificial Sequence
  PRIMER
aaaggatccgccacccaattctctctc

SEQ ID NO: 10718 - DNA, 31 bp, Artificial Sequence
  PRIMER
aaaggatccgcctagtgcctactccactgtc

SEQ ID NO: 10719 - DNA, 34 bp, Artificial Sequence
  PRIMER
aaaggatccgcctctcgagacttagagtatttcg

SEQ ID NO: 10720 - DNA, 30 bp, Artificial Sequence
  PRIMER
aaaggatccgcgacaaaagcaaaacctagc

SEQ ID NO: 10721 - DNA, 28 bp, Artificial Sequence
  PRIMER
aaaggatccgcgacagtgtaaacaccgg

SEQ ID NO: 10722 - DNA, 29 bp, Artificial Sequence
  PRIMER
aaaggatccgcgacatcgaatttcagagc

SEQ ID NO: 10723 - DNA, 31 bp, Artificial Sequence
  PRIMER
aaaggatccgctatacatcccaataagcctg

SEQ ID NO: 10724 - DNA, 31 bp, Artificial Sequence
  PRIMER
aaaggatccgctcatcaccagacaccactac

SEQ ID NO: 10725 - DNA, 31 bp, Artificial Sequence
  PRIMER
aaaggatccgctccctagtcgtcgtctaatc

SEQ ID NO: 10726 - DNA, 31 bp, Artificial Sequence
  PRIMER
aaaggatccgctttaaatacgaccacgaagc

SEQ ID NO: 10727 - DNA, 32 bp, Artificial Sequence
  PRIMER
aaaggatccggaatatacccattgtttcgtcc

SEQ ID NO: 10728 - DNA, 26 bp, Artificial Sequence
  PRIMER
aaaggatccggagggagcaaccatgg

SEQ ID NO: 10729 - DNA, 33 bp, Artificial Sequence
  PRIMER
aaaggatccggctatacagtttcgtaagggaag

SEQ ID NO: 10730 - DNA, 30 bp, Artificial Sequence
  PRIMER
aaaggatccggctgatagaatctttggcag

SEQ ID NO: 10731 - DNA, 32 bp, Artificial Sequence
  PRIMER
aaaggatccgggtagaacaagtgtcaaacaag

SEQ ID NO: 10732 - DNA, 32 bp, Artificial Sequence
  PRIMER
aaaggatccgggtttatcaggtgaagaagaag

SEQ ID NO: 10733 - DNA, 31 bp, Artificial Sequence
  PRIMER
aaaggatccggtctcaatttagtggaacacc

SEQ ID NO: 10734 - DNA, 30 bp, Artificial Sequence
  PRIMER
aaaggatccggtggagttcttgcctttctc

SEQ ID NO: 10735 - DNA, 26 bp, Artificial Sequence
  PRIMER
aaaggatccggttctcccccatctgc

SEQ ID NO: 10736 - DNA, 31 bp, Artificial Sequence
  PRIMER
aaaggatccggtttaggaacaacccatctcc

SEQ ID NO: 10737 - DNA, 31 bp, Artificial Sequence
  PRIMER
aaaggatccgtacaagttctggtggctgaag

SEQ ID NO: 10738 - DNA, 31 bp, Artificial Sequence
  PRIMER
aaaggatccgtacacacagcttcaggagcac

SEQ ID NO: 10739 - DNA, 30 bp, Artificial Sequence
  PRIMER
aaaggatccgtaccaagggattagcgatgg

SEQ ID NO: 10740 - DNA, 30 bp, Artificial Sequence
  PRIMER
aaaggatccgtagacctgcttgatccgacc

SEQ ID NO: 10741 - DNA, 32 bp, Artificial Sequence
  PRIMER
aaaggatccgtagagagaatccctcctcctcc

SEQ ID NO: 10742 - DNA, 31 bp, Artificial Sequence
  PRIMER
aaaggatccgtattggacacatggacactgc

SEQ ID NO: 10743 - DNA, 27 bp, Artificial Sequence
  PRIMER
aaaggatccgtcacatggacatgccaa

SEQ ID NO: 10744 - DNA, 31 bp, Artificial Sequence
  PRIMER
aaaggatccgtcacgtctaacgacaacaaac

SEQ ID NO: 10745 - DNA, 29 bp, Artificial Sequence
  PRIMER
aaaggatccgtctgtttcggtgcttcctc

SEQ ID NO: 10746 - DNA, 31 bp, Artificial Sequence
  PRIMER
aaaggatccgtgaagcaacacagatatgagg

SEQ ID NO: 10747 - DNA, 31 bp, Artificial Sequence
  PRIMER
aaaggatccgtgcctactccactgtccactc

SEQ ID NO: 10748 - DNA, 31 bp, Artificial Sequence
  PRIMER
aaaggatccgttgagcctcactccttattcc

SEQ ID NO: 10749 - DNA, 31 bp, Artificial Sequence
  PRIMER
aaaggatccgttggttggttcaagaatttcg

SEQ ID NO: 10750 - DNA, 28 bp, Artificial Sequence
  PRIMER
aaaggatccgtttcggtgcttcctcctc

SEQ ID NO: 10751 - DNA, 28 bp, Artificial Sequence
  PRIMER
aaaggatcctaaaaatggaggccactcg

SEQ ID NO: 10752 - DNA, 31 bp, Artificial Sequence
  PRIMER
aaaggatcctaaattactcagctccagccag

SEQ ID NO: 10753 - DNA, 27 bp, Artificial Sequence
  PRIMER
aaaggatcctaacgcgactgcctgttc

SEQ ID NO: 10754 - DNA, 31 bp, Artificial Sequence
  PRIMER
aaaggatcctaatcttccaaaagggtagtcg

SEQ ID NO: 10755 - DNA, 33 bp, Artificial Sequence
  PRIMER
aaaggatcctacaggtgaaaccaaacaacatag

SEQ ID NO: 10756 - DNA, 31 bp, Artificial Sequence
  PRIMER
aaaggatcctacataagctgagggaaccagg

SEQ ID NO: 10757 - DNA, 29 bp, Artificial Sequence
  PRIMER
aaaggatcctacctgacctccactgctcc

SEQ ID NO: 10758 - DNA, 31 bp, Artificial Sequence
  PRIMER
aaaggatcctagatcccaaacagtctcctgc

SEQ ID NO: 10759 - DNA, 26 bp, Artificial Sequence
  PRIMER
aaaggatcctagcagcagcagcagca

SEQ ID NO: 10760 - DNA, 31 bp, Artificial Sequence
  PRIMER
aaaggatcctatagcggatcttctgggtctc

SEQ ID NO: 10761 - DNA, 30 bp, Artificial Sequence
  PRIMER
aaaggatcctcacccatacaatgcatcctc

SEQ ID NO: 10762 - DNA, 28 bp, Artificial Sequence
  PRIMER
aaaggatcctccagccgaaaaaactcac

SEQ ID NO: 10763 - DNA, 31 bp, Artificial Sequence
  PRIMER
aaaggatcctccataattaggtagtggctgg

SEQ ID NO: 10764 - DNA, 32 bp, Artificial Sequence
  PRIMER
aaaggatcctcctggctagcctatataacaac

SEQ ID NO: 10765 - DNA, 31 bp, Artificial Sequence
  PRIMER
aaaggatcctccttattccattccaaccaac

SEQ ID NO: 10766 - DNA, 31 bp, Artificial Sequence
  PRIMER
aaaggatcctctaatcaacaatcccgcaatc

SEQ ID NO: 10767 - DNA, 36 bp, Artificial Sequence
  PRIMER
aaaggatcctctacgcaagagaagaatagaaaatgg

SEQ ID NO: 10768 - DNA, 29 bp, Artificial Sequence
  PRIMER
aaaggatcctctctgatcgagattcctgc

SEQ ID NO: 10769 - DNA, 31 bp, Artificial Sequence
  PRIMER
aaaggatcctctgtcgtgtcaggttacttgc

SEQ ID NO: 10770 - DNA, 30 bp, Artificial Sequence
  PRIMER
aaaggatcctgacgcacattcacaagttag

SEQ ID NO: 10771 - DNA, 31 bp, Artificial Sequence
  PRIMER
aaaggatcctgagtaggagcgtaggagttgg

SEQ ID NO: 10772 - DNA, 33 bp, Artificial Sequence
  PRIMER
aaaggatcctgatcaaccataaacttattcacc

SEQ ID NO: 10773 - DNA, 26 bp, Artificial Sequence
  PRIMER
aaaggatcctgcctcccctctcctca

SEQ ID NO: 10774 - DNA, 29 bp, Artificial Sequence
  PRIMER
aaaggatcctgcttcagcatctcctcctc

SEQ ID NO: 10775 - DNA, 29 bp, Artificial Sequence
  PRIMER
aaaggatcctggacgaagatggtaaatgg

SEQ ID NO: 10776 - DNA, 31 bp, Artificial Sequence
  PRIMER
aaaggatcctggactatgacaattccttgtg

SEQ ID NO: 10777 - DNA, 34 bp, Artificial Sequence
  PRIMER
aaaggatcctggtgctgttaatatagctgattgg

SEQ ID NO: 10778 - DNA, 30 bp, Artificial Sequence
  PRIMER
aaaggatcctgtaccaacaaccgctatcac

SEQ ID NO: 10779 - DNA, 31 bp, Artificial Sequence
  PRIMER
aaaggatccttagacaacgacccaaaccaac

SEQ ID NO: 10780 - DNA, 32 bp, Artificial Sequence
  PRIMER
aaaggatccttatcttgagaagaaccacacac

SEQ ID NO: 10781 - DNA, 31 bp, Artificial Sequence
  PRIMER
aaaggatccttcaagttcaatattggcgagc

SEQ ID NO: 10782 - DNA, 31 bp, Artificial Sequence
  PRIMER
aaaggatccttccactacaacgataagcaag

SEQ ID NO: 10783 - DNA, 28 bp, Artificial Sequence
  PRIMER
aaaggatccttccatttcccaaacccac

SEQ ID NO: 10784 - DNA, 31 bp, Artificial Sequence
  PRIMER
aaaggatccttcgtttgctttatatctcctg

SEQ ID NO: 10785 - DNA, 30 bp, Artificial Sequence
  PRIMER
aaaggatccttctcattcaatcggatcaac

SEQ ID NO: 10786 - DNA, 29 bp, Artificial Sequence
  PRIMER
aaaggatccttctccacccactgactgac

SEQ ID NO: 10787 - DNA, 26 bp, Artificial Sequence
  PRIMER
aaaggatccttggctgcctcccctct

SEQ ID NO: 10788 - DNA, 31 bp, Artificial Sequence
  PRIMER
aaaggtaccaaaattgatcagcaacacgctc

SEQ ID NO: 10789 - DNA, 31 bp, Artificial Sequence
  PRIMER
aaaggtaccaaacaggatcacagatcacagc

SEQ ID NO: 10790 - DNA, 31 bp, Artificial Sequence
  PRIMER
aaaggtaccaaaccaagccagctgatcatac

SEQ ID NO: 10791 - DNA, 36 bp, Artificial Sequence
  PRIMER
aaaggtaccaaacttgtaatagcagaatcttagagc

SEQ ID NO: 10792 - DNA, 31 bp, Artificial Sequence
  PRIMER
aaaggtaccaacagtggaataactgcacaac

SEQ ID NO: 10793 - DNA, 31 bp, Artificial Sequence
  PRIMER
aaaggtaccaacatatgcatggtaagggacg

SEQ ID NO: 10794 - DNA, 31 bp, Artificial Sequence
  PRIMER
aaaggtaccaactcccacaggcaattattag

SEQ ID NO: 10795 - DNA, 31 bp, Artificial Sequence
  PRIMER
aaaggtaccaactgattcatctgcacaccac

SEQ ID NO: 10796 - DNA, 31 bp, Artificial Sequence
  PRIMER
aaaggtaccaagaaatggaaaccaacgacac

SEQ ID NO: 10797 - DNA, 31 bp, Artificial Sequence
  PRIMER
aaaggtaccaagtgccaaactgatggtaagc

SEQ ID NO: 10798 - DNA, 31 bp, Artificial Sequence
  PRIMER
aaaggtaccaatatggaccaagagcttgcag

SEQ ID NO: 10799 - DNA, 32 bp, Artificial Sequence
  PRIMER
aaaggtaccaattaaaatatcgaagcaagtcg

SEQ ID NO: 10800 - DNA, 31 bp, Artificial Sequence
  PRIMER
aaaggtaccacaacgacctacaaatccttgc

SEQ ID NO: 10801 - DNA, 31 bp, Artificial Sequence
  PRIMER
aaaggtaccaccaccaaatgcagtagaatcc

SEQ ID NO: 10802 - DNA, 31 bp, Artificial Sequence
  PRIMER
aaaggtaccaccagtcatcatacagcacttc

SEQ ID NO: 10803 - DNA, 27 bp, Artificial Sequence
  PRIMER
aaaggtaccacccaatttggcaacaag

SEQ ID NO: 10804 - DNA, 31 bp, Artificial Sequence
  PRIMER
aaaggtaccaccgttcaagctacaacctcac

SEQ ID NO: 10805 - DNA, 31 bp, Artificial Sequence
  PRIMER
aaaggtaccacgatgagtcgctctagctctc

SEQ ID NO: 10806 - DNA, 30 bp, Artificial Sequence
  PRIMER
aaaggtaccacggtttgatttctgtgaatc

SEQ ID NO: 10807 - DNA, 31 bp, Artificial Sequence
  PRIMER
aaaggtaccactatgcctctgctcagcaatc

SEQ ID NO: 10808 - DNA, 31 bp, Artificial Sequence
  PRIMER
aaaggtaccacttggcaataaagcaagaaag

SEQ ID NO: 10809 - DNA, 31 bp, Artificial Sequence
  PRIMER
aaaggtaccagaaatgccaaagcttctgatg

SEQ ID NO: 10810 - DNA, 31 bp, Artificial Sequence
  PRIMER
aaaggtaccagaccacctatccacatccatc

SEQ ID NO: 10811 - DNA, 31 bp, Artificial Sequence
  PRIMER
aaaggtaccagagcgtaagggacatgttctg

SEQ ID NO: 10812 - DNA, 31 bp, Artificial Sequence
  PRIMER
aaaggtaccagataatgcccacacagagagc

SEQ ID NO: 10813 - DNA, 31 bp, Artificial Sequence
  PRIMER
aaaggtaccagcgagtacagatcgaccaaac

SEQ ID NO: 10814 - DNA, 29 bp, Artificial Sequence
  PRIMER
aaaggtaccagtcaactgtggaatgcagc

SEQ ID NO: 10815 - DNA, 31 bp, Artificial Sequence
  PRIMER
aaaggtaccagtcacataatgcgttcagcag

SEQ ID NO: 10816 - DNA, 31 bp, Artificial Sequence
  PRIMER
aaaggtaccagtcatcaacaaggcaaagtcc

SEQ ID NO: 10817 - DNA, 31 bp, Artificial Sequence
  PRIMER
aaaggtaccagtgtggaacagcgaaagaaac

SEQ ID NO: 10818 - DNA, 31 bp, Artificial Sequence
  PRIMER
aaaggtaccagttgcaaccatattgagcctg

SEQ ID NO: 10819 - DNA, 31 bp, Artificial Sequence
  PRIMER
aaaggtaccataaccaccagccttatgcaag

SEQ ID NO: 10820 - DNA, 31 bp, Artificial Sequence
  PRIMER
aaaggtaccataacggcttgataacacgaac

SEQ ID NO: 10821 - DNA, 31 bp, Artificial Sequence
  PRIMER
aaaggtaccatacagatttgcatccctggac

SEQ ID NO: 10822 - DNA, 31 bp, Artificial Sequence
  PRIMER
aaaggtaccatagtcacccttcaggacaaag

SEQ ID NO: 10823 - DNA, 31 bp, Artificial Sequence
  PRIMER
aaaggtaccatatgccagcttcactttctgc

SEQ ID NO: 10824 - DNA, 31 bp, Artificial Sequence
  PRIMER
aaaggtaccatcatggtgtcgtctgagtctg

SEQ ID NO: 10825 - DNA, 28 bp, Artificial Sequence
  PRIMER
aaaggtaccatccacagggagagaaacc

SEQ ID NO: 10826 - DNA, 36 bp, Artificial Sequence
  PRIMER
aaaggtaccattataccaatgcgaacagagtctaag

SEQ ID NO: 10827 - DNA, 31 bp, Artificial Sequence
  PRIMER
aaaggtaccattgggtgaacgtctttgacag

SEQ ID NO: 10828 - DNA, 31 bp, Artificial Sequence
  PRIMER
aaaggtaccatttcggtgggcattttacttg

SEQ ID NO: 10829 - DNA, 31 bp, Artificial Sequence
  PRIMER
aaaggtacccaacgtcgatgctctacagaag

SEQ ID NO: 10830 - DNA, 28 bp, Artificial Sequence
  PRIMER
aaaggtacccaaggtggttggttgcttg

SEQ ID NO: 10831 - DNA, 31 bp, Artificial Sequence
  PRIMER
aaaggtacccaatcaaccaatctcaatgcac

SEQ ID NO: 10832 - DNA, 31 bp, Artificial Sequence
  PRIMER
aaaggtacccacacaattccgatctccaaac

SEQ ID NO: 10833 - DNA, 30 bp, Artificial Sequence
  PRIMER
aaaggtacccacacatctatgatgcaaggc

SEQ ID NO: 10834 - DNA, 30 bp, Artificial Sequence
  PRIMER
aaaggtacccacagcagtttccatcatttc

SEQ ID NO: 10835 - DNA, 31 bp, Artificial Sequence
  PRIMER
aaaggtacccacatccatccgactaacaacc

SEQ ID NO: 10836 - DNA, 31 bp, Artificial Sequence
  PRIMER
aaaggtacccaccacgagatgacaatcaaag

SEQ ID NO: 10837 - DNA, 31 bp, Artificial Sequence
  PRIMER
aaaggtacccaccatacatgcaaatccagtc

SEQ ID NO: 10838 - DNA, 33 bp, Artificial Sequence
  PRIMER
aaaggtacccagatattactttgccacatttcg

SEQ ID NO: 10839 - DNA, 34 bp, Artificial Sequence
  PRIMER
aaaggtacccagcattgaaacactacctagactg

SEQ ID NO: 10840 - DNA, 31 bp, Artificial Sequence
  PRIMER
aaaggtacccaggcctcagaaagacaacttc

SEQ ID NO: 10841 - DNA, 28 bp, Artificial Sequence
  PRIMER
aaaggtacccagttgacggcatgaatcg

SEQ ID NO: 10842 - DNA, 32 bp, Artificial Sequence
  PRIMER
aaaggtacccatgcaactagacaacacaatcg

SEQ ID NO: 10843 - DNA, 31 bp, Artificial Sequence
  PRIMER
aaaggtacccatgcatgcacagatattgagg

SEQ ID NO: 10844 - DNA, 33 bp, Artificial Sequence
  PRIMER
aaaggtacccattataccaatgcgaacagagtc

SEQ ID NO: 10845 - DNA, 31 bp, Artificial Sequence
  PRIMER
aaaggtaccccacaactttgcaacgacatac

SEQ ID NO: 10846 - DNA, 31 bp, Artificial Sequence
  PRIMER
aaaggtacccccaagcctgaacattattacg

SEQ ID NO: 10847 - DNA, 31 bp, Artificial Sequence
  PRIMER
aaaggtacccccatggccaataacattatac

SEQ ID NO: 10848 - DNA, 31 bp, Artificial Sequence
  PRIMER
aaaggtacccgccatgagattacagttacag

SEQ ID NO: 10849 - DNA, 31 bp, Artificial Sequence
  PRIMER
aaaggtacccggaacaaatccacatacaaag

SEQ ID NO: 10850 - DNA, 31 bp, Artificial Sequence
  PRIMER
aaaggtacccggatcttcacttccatttgag

SEQ ID NO: 10851 - DNA, 27 bp, Artificial Sequence
  PRIMER
aaaggtacccggatttaggaaccgtgg

SEQ ID NO: 10852 - DNA, 36 bp, Artificial Sequence
  PRIMER
aaaggtacccgtaaactcaagtcaacttaaactacc

SEQ ID NO: 10853 - DNA, 31 bp, Artificial Sequence
  PRIMER
aaaggtacccgttcatgattcttgtttcgtg

SEQ ID NO: 10854 - DNA, 32 bp, Artificial Sequence
  PRIMER
aaaggtaccctaaaaggaagacgaaggtgtgc

SEQ ID NO: 10855 - DNA, 34 bp, Artificial Sequence
  PRIMER
aaaggtaccctaaatatcgatcacatcccacacc

SEQ ID NO: 10856 - DNA, 39 bp, Artificial Sequence
  PRIMER
aaaggtaccctaacataaactactagtgacccattcttc

SEQ ID NO: 10857 - DNA, 34 bp, Artificial Sequence
  PRIMER
aaaggtaccctaactagtgacccattcttccatc

SEQ ID NO: 10858 - DNA, 34 bp, Artificial Sequence
  PRIMER
aaaggtaccctaagtacatattgcgaagctgctg

SEQ ID NO: 10859 - DNA, 31 bp, Artificial Sequence
  PRIMER
aaaggtaccctacaaactgctcgagtgcaag

SEQ ID NO: 10860 - DNA, 34 bp, Artificial Sequence
  PRIMER
aaaggtaccctacaaataccgaaatcctctctcg

SEQ ID NO: 10861 - DNA, 34 bp, Artificial Sequence
  PRIMER
aaaggtaccctacactgaattaaggcaaaacagc

SEQ ID NO: 10862 - DNA, 34 bp, Artificial Sequence
  PRIMER
aaaggtaccctacagacctttgtgacaagatgag

SEQ ID NO: 10863 - DNA, 33 bp, Artificial Sequence
  PRIMER
aaaggtaccctacgaactcatgcatttcatcac

SEQ ID NO: 10864 - DNA, 34 bp, Artificial Sequence
  PRIMER
aaaggtaccctacggaaagatagaaaagcattgg

SEQ ID NO: 10865 - DNA, 34 bp, Artificial Sequence
  PRIMER
aaaggtaccctagaaattcaccattccatagctc

SEQ ID NO: 10866 - DNA, 33 bp, Artificial Sequence
  PRIMER
aaaggtaccctagaagctgctgctcatgtcatc

SEQ ID NO: 10867 - DNA, 33 bp, Artificial Sequence
  PRIMER
aaaggtaccctagaccagagctccagaagaacc

SEQ ID NO: 10868 - DNA, 34 bp, Artificial Sequence
  PRIMER
aaaggtaccctagaccataagcagagacggaaag

SEQ ID NO: 10869 - DNA, 31 bp, Artificial Sequence
  PRIMER
aaaggtaccctagcagccacctccaactaac

SEQ ID NO: 10870 - DNA, 34 bp, Artificial Sequence
  PRIMER
aaaggtaccctagctaatgaaggaaaccataacg

SEQ ID NO: 10871 - DNA, 34 bp, Artificial Sequence
  PRIMER
aaaggtaccctaggaaatagacttgccagaaatg

SEQ ID NO: 10872 - DNA, 34 bp, Artificial Sequence
  PRIMER
aaaggtaccctagtgctcaatcctgataacaacc

SEQ ID NO: 10873 - DNA, 34 bp, Artificial Sequence
  PRIMER
aaaggtaccctagtgttccatttcacagcacaag

SEQ ID NO: 10874 - DNA, 35 bp, Artificial Sequence
  PRIMER
aaaggtaccctatacagttgcagaagaacagtcag

SEQ ID NO: 10875 - DNA, 31 bp, Artificial Sequence
  PRIMER
aaaggtaccctatctggtagcacatggcctc

SEQ ID NO: 10876 - DNA, 34 bp, Artificial Sequence
  PRIMER
aaaggtaccctatgcagaagaacagtcagaaatg

SEQ ID NO: 10877 - DNA, 36 bp, Artificial Sequence
  PRIMER
aaaggtaccctattcattaagacaacattttgaagg

SEQ ID NO: 10878 - DNA, 36 bp, Artificial Sequence
  PRIMER
aaaggtaccctatttgcaacaacacatataacaaag

SEQ ID NO: 10879 - DNA, 34 bp, Artificial Sequence
  PRIMER
aaaggtaccctatttgtgctgaaagttcattttg

SEQ ID NO: 10880 - DNA, 29 bp, Artificial Sequence
  PRIMER
aaaggtaccctctcgaacaccaacagctg

SEQ ID NO: 10881 - DNA, 28 bp, Artificial Sequence
  PRIMER
aaaggtaccctgggcaatgtcaaacacc

SEQ ID NO: 10882 - DNA, 30 bp, Artificial Sequence
  PRIMER
aaaggtaccgacgtgcaccaaattaccaac

SEQ ID NO: 10883 - DNA, 31 bp, Artificial Sequence
  PRIMER
aaaggtaccgaggcaatgtcatcgaattctc

SEQ ID NO: 10884 - DNA, 31 bp, Artificial Sequence
  PRIMER
aaaggtaccgatacatcaaacggcatgtcac

SEQ ID NO: 10885 - DNA, 32 bp, Artificial Sequence
  PRIMER
aaaggtaccgcaaacatagtcgcacgaataac

SEQ ID NO: 10886 - DNA, 31 bp, Artificial Sequence
  PRIMER
aaaggtaccgcaatgatctgtcttgtttgac

SEQ ID NO: 10887 - DNA, 34 bp, Artificial Sequence
  PRIMER
aaaggtaccgcagaatcttagagctgatacaatc

SEQ ID NO: 10888 - DNA, 28 bp, Artificial Sequence
  PRIMER
aaaggtaccgcataacaaaccggcaatc

SEQ ID NO: 10889 - DNA, 31 bp, Artificial Sequence
  PRIMER
aaaggtaccgcatagccattacccacgtatc

SEQ ID NO: 10890 - DNA, 31 bp, Artificial Sequence
  PRIMER
aaaggtaccgcctaagctcataccactcagc

SEQ ID NO: 10891 - DNA, 31 bp, Artificial Sequence
  PRIMER
aaaggtaccgctacttcaaacccatgcaaag

SEQ ID NO: 10892 - DNA, 31 bp, Artificial Sequence
  PRIMER
aaaggtaccgctatacaccatccatccatcc

SEQ ID NO: 10893 - DNA, 31 bp, Artificial Sequence
  PRIMER
aaaggtaccgctcatcgccgattattattcc

SEQ ID NO: 10894 - DNA, 31 bp, Artificial Sequence
  PRIMER
aaaggtaccgctgagaagtgataacatgcac

SEQ ID NO: 10895 - DNA, 31 bp, Artificial Sequence
  PRIMER
aaaggtaccgcttgacacagatcaagagcag

SEQ ID NO: 10896 - DNA, 31 bp, Artificial Sequence
  PRIMER
aaaggtaccggaaagctcaccaagacttatc

SEQ ID NO: 10897 - DNA, 31 bp, Artificial Sequence
  PRIMER
aaaggtaccggaactgattacagaaccgagc

SEQ ID NO: 10898 - DNA, 31 bp, Artificial Sequence
  PRIMER
aaaggtaccggatgattacatcctcttccac

SEQ ID NO: 10899 - DNA, 31 bp, Artificial Sequence
  PRIMER
aaaggtaccggctgcaggacttattcaaatc

SEQ ID NO: 10900 - DNA, 31 bp, Artificial Sequence
  PRIMER
aaaggtaccgtacagcgtattcacaaggtgg

SEQ ID NO: 10901 - DNA, 31 bp, Artificial Sequence
  PRIMER
aaaggtaccgtacatacagcgcatttcctcc

SEQ ID NO: 10902 - DNA, 31 bp, Artificial Sequence
  PRIMER
aaaggtaccgtcaaatcatcgttcttccacc

SEQ ID NO: 10903 - DNA, 33 bp, Artificial Sequence
  PRIMER
aaaggtaccgtcaacttaaactaccaacattcg

SEQ ID NO: 10904 - DNA, 31 bp, Artificial Sequence
  PRIMER
aaaggtaccgttgaaggcatacttctccatc

SEQ ID NO: 10905 - DNA, 31 bp, Artificial Sequence
  PRIMER
aaaggtacctaacaaagtgaatgtcatgctg

SEQ ID NO: 10906 - DNA, 31 bp, Artificial Sequence
  PRIMER
aaaggtacctaaccgacagtctcaaatgctg

SEQ ID NO: 10907 - DNA, 31 bp, Artificial Sequence
  PRIMER
aaaggtacctaatcaggcagtaccttccagg

SEQ ID NO: 10908 - DNA, 31 bp, Artificial Sequence
  PRIMER
aaaggtacctaatcggcaataagcgggtaac

SEQ ID NO: 10909 - DNA, 31 bp, Artificial Sequence
  PRIMER
aaaggtacctacagccatctcatcacacctc

SEQ ID NO: 10910 - DNA, 31 bp, Artificial Sequence
  PRIMER
aaaggtacctaccattctttcgagtgacagc

SEQ ID NO: 10911 - DNA, 36 bp, Artificial Sequence
  PRIMER
aaaggtacctagagttgagttgacaccatatgctac

SEQ ID NO: 10912 - DNA, 31 bp, Artificial Sequence
  PRIMER
aaaggtacctatatagcgtgccactgcagac

SEQ ID NO: 10913 - DNA, 31 bp, Artificial Sequence
  PRIMER
aaaggtacctatcagtttgaataacggcttg

SEQ ID NO: 10914 - DNA, 31 bp, Artificial Sequence
  PRIMER
aaaggtacctatgctagtgtgccaagagttc

SEQ ID NO: 10915 - DNA, 29 bp, Artificial Sequence
  PRIMER
aaaggtacctatggatacgtgcacagcag

SEQ ID NO: 10916 - DNA, 31 bp, Artificial Sequence
  PRIMER
aaaggtacctatgtgttgcatcgcaattctc

SEQ ID NO: 10917 - DNA, 31 bp, Artificial Sequence
  PRIMER
aaaggtacctcaaacaccgcttctttacagg

SEQ ID NO: 10918 - DNA, 36 bp, Artificial Sequence
  PRIMER
aaaggtacctcaaggtcatttcttatccacattacc

SEQ ID NO: 10919 - DNA, 34 bp, Artificial Sequence
  PRIMER
aaaggtacctcaatccacatatatataccgcgac

SEQ ID NO: 10920 - DNA, 31 bp, Artificial Sequence
  PRIMER
aaaggtacctcacctattgctcaacatccag

SEQ ID NO: 10921 - DNA, 31 bp, Artificial Sequence
  PRIMER
aaaggtacctcactggaaagggtaagacacc

SEQ ID NO: 10922 - DNA, 31 bp, Artificial Sequence
  PRIMER
aaaggtacctcattaacagccatgaccaaac

SEQ ID NO: 10923 - DNA, 37 bp, Artificial Sequence
  PRIMER
aaaggtacctcattagaagtgtatcctgctaggttga

SEQ ID NO: 10924 - DNA, 31 bp, Artificial Sequence
  PRIMER
aaaggtacctcattcggacaaagtcatcaac

SEQ ID NO: 10925 - DNA, 31 bp, Artificial Sequence
  PRIMER
aaaggtacctccatcaactggctgtaatcag

SEQ ID NO: 10926 - DNA, 31 bp, Artificial Sequence
  PRIMER
aaaggtacctcctcacaatcaaacaccagag

SEQ ID NO: 10927 - DNA, 31 bp, Artificial Sequence
  PRIMER
aaaggtacctcgagacggcatatcatacaag

SEQ ID NO: 10928 - DNA, 31 bp, Artificial Sequence
  PRIMER
aaaggtacctcgatgatacaaatatggcaac

SEQ ID NO: 10929 - DNA, 31 bp, Artificial Sequence
  PRIMER
aaaggtacctcgtggagaaagcctaactgag

SEQ ID NO: 10930 - DNA, 31 bp, Artificial Sequence
  PRIMER
aaaggtacctctcccgtatcacacaactcac

SEQ ID NO: 10931 - DNA, 31 bp, Artificial Sequence
  PRIMER
aaaggtacctcttgctacactcctgcatctc

SEQ ID NO: 10932 - DNA, 31 bp, Artificial Sequence
  PRIMER
aaaggtacctgaaggctcatttcttggaaag

SEQ ID NO: 10933 - DNA, 31 bp, Artificial Sequence
  PRIMER
aaaggtacctgacaaccatcaaatttggaac

SEQ ID NO: 10934 - DNA, 31 bp, Artificial Sequence
  PRIMER
aaaggtacctgacgccttcaaagtagagttg

SEQ ID NO: 10935 - DNA, 31 bp, Artificial Sequence
  PRIMER
aaaggtacctgatactggtagtgtgccttcg

SEQ ID NO: 10936 - DNA, 32 bp, Artificial Sequence
  PRIMER
aaaggtacctgcaatacatttctcaaatcaag

SEQ ID NO: 10937 - DNA, 31 bp, Artificial Sequence
  PRIMER
aaaggtacctgcaatatgagtcgcttacacc

SEQ ID NO: 10938 - DNA, 31 bp, Artificial Sequence
  PRIMER
aaaggtacctgcacaaggcacttacaaagtc

SEQ ID NO: 10939 - DNA, 31 bp, Artificial Sequence
  PRIMER
aaaggtacctgcacttcacatctcacaagag

SEQ ID NO: 10940 - DNA, 31 bp, Artificial Sequence
  PRIMER
aaaggtacctgcaggctctgtgtgaataaac

SEQ ID NO: 10941 - DNA, 31 bp, Artificial Sequence
  PRIMER
aaaggtacctgcatctactccatttacaagc

SEQ ID NO: 10942 - DNA, 31 bp, Artificial Sequence
  PRIMER
aaaggtacctgcatttcgtcctcatgttatg

SEQ ID NO: 10943 - DNA, 30 bp, Artificial Sequence
  PRIMER
aaaggtacctgccaaagcttctgatgtgtc

SEQ ID NO: 10944 - DNA, 31 bp, Artificial Sequence
  PRIMER
aaaggtacctgcccacagtaaagaacaaagc

SEQ ID NO: 10945 - DNA, 36 bp, Artificial Sequence
  PRIMER
aaaggtacctggatacatacaaataccaactctaag

SEQ ID NO: 10946 - DNA, 31 bp, Artificial Sequence
  PRIMER
aaaggtacctgtaggcactctaaagccaacc

SEQ ID NO: 10947 - DNA, 30 bp, Artificial Sequence
  PRIMER
aaaggtaccttaaaggaatgtcgacacctg

SEQ ID NO: 10948 - DNA, 31 bp, Artificial Sequence
  PRIMER
aaaggtaccttaacatgaaagaaacgcctcc

SEQ ID NO: 10949 - DNA, 31 bp, Artificial Sequence
  PRIMER
aaaggtaccttacagtcccagcaaacatctg

SEQ ID NO: 10950 - DNA, 31 bp, Artificial Sequence
  PRIMER
aaaggtaccttactcacaaacgtagaccgtg

SEQ ID NO: 10951 - DNA, 31 bp, Artificial Sequence
  PRIMER
aaaggtaccttagctcaaaccatacccaagc

SEQ ID NO: 10952 - DNA, 34 bp, Artificial Sequence
  PRIMER
aaaggtaccttatgccatatagaaactccaggtc

SEQ ID NO: 10953 - DNA, 31 bp, Artificial Sequence
  PRIMER
aaaggtaccttcacaaggcatagttccacac

SEQ ID NO: 10954 - DNA, 31 bp, Artificial Sequence
  PRIMER
aaaggtaccttcaccaagggaagtagcaaac

SEQ ID NO: 10955 - DNA, 31 bp, Artificial Sequence
  PRIMER
aaaggtaccttcgggtgatttatttgaccac

SEQ ID NO: 10956 - DNA, 31 bp, Artificial Sequence
  PRIMER
aaaggtaccttcttgaccaatcaatatgctg

SEQ ID NO: 10957 - DNA, 31 bp, Artificial Sequence
  PRIMER
aaaggtaccttgaccttcaaatagaccctgc

SEQ ID NO: 10958 - DNA, 31 bp, Artificial Sequence
  PRIMER
aaaggtaccttgcagttctgtgtcttcttgg

SEQ ID NO: 10959 - DNA, 32 bp, Artificial Sequence
  PRIMER
aaaggtaccttgcctttcaagtttcaacaaag

SEQ ID NO: 10960 - DNA, 31 bp, Artificial Sequence
  PRIMER
aaaggtaccttgtgtcacgcaagaatatagg

SEQ ID NO: 10961 - DNA, 31 bp, Artificial Sequence
  PRIMER
aaaggtaccttgtgtcatgtgaactggattg

SEQ ID NO: 10962 - DNA, 33 bp, Artificial Sequence
  PRIMER
aaaggtaccttgttcattccatacttgttcacc

SEQ ID NO: 10963 - DNA, 28 bp, Artificial Sequence
  PRIMER
aaagtcgacaaaccccaaccatgtctgc

SEQ ID NO: 10964 - DNA, 31 bp, Artificial Sequence
  PRIMER
aaagtcgacaaccgggtttctagccctaatc

SEQ ID NO: 10965 - DNA, 32 bp, Artificial Sequence
  PRIMER
aaagtcgacaactagcccagcccatgtatatc

SEQ ID NO: 10966 - DNA, 31 bp, Artificial Sequence
  PRIMER
aaagtcgacaactcagtggaaatgaaagacg

SEQ ID NO: 10967 - DNA, 30 bp, Artificial Sequence
  PRIMER
aaagtcgacaagaggagatctcgttggagc

SEQ ID NO: 10968 - DNA, 31 bp, Artificial Sequence
  PRIMER
aaagtcgacaaggaagaggagatctcgttgg

SEQ ID NO: 10969 - DNA, 31 bp, Artificial Sequence
  PRIMER
aaagtcgacaaggacaagtaagcaaagcacc

SEQ ID NO: 10970 - DNA, 31 bp, Artificial Sequence
  PRIMER
aaagtcgacaagtccatagccagcgaaactc

SEQ ID NO: 10971 - DNA, 29 bp, Artificial Sequence
  PRIMER
aaagtcgacaagtggcgatcacaccaaac

SEQ ID NO: 10972 - DNA, 31 bp, Artificial Sequence
  PRIMER
aaagtcgacaataaccctccctcccagactc

SEQ ID NO: 10973 - DNA, 31 bp, Artificial Sequence
  PRIMER
aaagtcgacaatcgagtgagccagagttgag

SEQ ID NO: 10974 - DNA, 31 bp, Artificial Sequence
  PRIMER
aaagtcgacaattccagacaccacacaggac

SEQ ID NO: 10975 - DNA, 31 bp, Artificial Sequence
  PRIMER
aaagtcgacacacccatttgataaagtttgg

SEQ ID NO: 10976 - DNA, 27 bp, Artificial Sequence
  PRIMER
aaagtcgacacagcgctagcggcatag

SEQ ID NO: 10977 - DNA, 30 bp, Artificial Sequence
  PRIMER
aaagtcgacaccggtagcactagcaggaac

SEQ ID NO: 10978 - DNA, 36 bp, Artificial Sequence
  PRIMER
aaagtcgacacgaaaacaccattagatttaagtcac

SEQ ID NO: 10979 - DNA, 30 bp, Artificial Sequence
  PRIMER
aaagtcgacactccctcgtcaattcacctc

SEQ ID NO: 10980 - DNA, 29 bp, Artificial Sequence
  PRIMER
aaagtcgacagctagcagcagctcaaacc

SEQ ID NO: 10981 - DNA, 29 bp, Artificial Sequence
  PRIMER
aaagtcgacagctagccgctagggtttcc

SEQ ID NO: 10982 - DNA, 35 bp, Artificial Sequence
  PRIMER
aaagtcgacagctcctaagctaaaggaaaggtaac

SEQ ID NO: 10983 - DNA, 27 bp, Artificial Sequence
  PRIMER
aaagtcgacaggctgtttgttgcccac

SEQ ID NO: 10984 - DNA, 31 bp, Artificial Sequence
  PRIMER
aaagtcgacatcagaaaggctgtctccttgg

SEQ ID NO: 10985 - DNA, 30 bp, Artificial Sequence
  PRIMER
aaagtcgacatcgcaaccaaatcattagtc

SEQ ID NO: 10986 - DNA, 31 bp, Artificial Sequence
  PRIMER
aaagtcgacatctagttgctgtggctttgtg

SEQ ID NO: 10987 - DNA, 31 bp, Artificial Sequence
  PRIMER
aaagtcgacatctcttgggtcatcctctacg

SEQ ID NO: 10988 - DNA, 31 bp, Artificial Sequence
  PRIMER
aaagtcgacattaaaccctagcagcgattcc

SEQ ID NO: 10989 - DNA, 31 bp, Artificial Sequence
  PRIMER
aaagtcgacattcactcatttcatgaccatc

SEQ ID NO: 10990 - DNA, 31 bp, Artificial Sequence
  PRIMER
aaagtcgacattcggctaatttcctcgtctc

SEQ ID NO: 10991 - DNA, 31 bp, Artificial Sequence
  PRIMER
aaagtcgaccacccagtagattgtgaattgc

SEQ ID NO: 10992 - DNA, 34 bp, Artificial Sequence
  PRIMER
aaagtcgaccagatctatgagtgagcaactgaag

SEQ ID NO: 10993 - DNA, 32 bp, Artificial Sequence
  PRIMER
aaagtcgaccaggtagtcagtccagagagacg

SEQ ID NO: 10994 - DNA, 29 bp, Artificial Sequence
  PRIMER
aaagtcgaccattacccagacctcgcatc

SEQ ID NO: 10995 - DNA, 31 bp, Artificial Sequence
  PRIMER
aaagtcgaccattacgctagcaaattcagtg

SEQ ID NO: 10996 - DNA, 27 bp, Artificial Sequence
  PRIMER
aaagtcgaccatttcgctccgcatagg

SEQ ID NO: 10997 - DNA, 27 bp, Artificial Sequence
  PRIMER
aaagtcgacccaaaccccaaccatgtc

SEQ ID NO: 10998 - DNA, 30 bp, Artificial Sequence
  PRIMER
aaagtcgacccacttcgtttgataccctcg

SEQ ID NO: 10999 - DNA, 31 bp, Artificial Sequence
  PRIMER
aaagtcgacccatttctagtggttcaatacg

SEQ ID NO: 11000 - DNA, 26 bp, Artificial Sequence
  PRIMER
aaagtcgaccccaaatggaggaccca

SEQ ID NO: 11001 - DNA, 29 bp, Artificial Sequence
  PRIMER
aaagtcgacccctgcaccaaatacctgac

SEQ ID NO: 11002 - DNA, 29 bp, Artificial Sequence
  PRIMER
aaagtcgacccggagaagaagcctagacc

SEQ ID NO: 11003 - DNA, 32 bp, Artificial Sequence
  PRIMER
aaagtcgaccctacagcctacaaccaactgag

SEQ ID NO: 11004 - DNA, 30 bp, Artificial Sequence
  PRIMER
aaagtcgaccctcaactccctcgtcaattc

SEQ ID NO: 11005 - DNA, 32 bp, Artificial Sequence
  PRIMER
aaagtcgaccctcgcatctagctagttccatc

SEQ ID NO: 11006 - DNA, 30 bp, Artificial Sequence
  PRIMER
aaagtcgaccgattcctctccagtctcgtc

SEQ ID NO: 11007 - DNA, 31 bp, Artificial Sequence
  PRIMER
aaagtcgacctacaaccaactgagacgaacg

SEQ ID NO: 11008 - DNA, 29 bp, Artificial Sequence
  PRIMER
aaagtcgacctcagctgaacgtgaacagg

SEQ ID NO: 11009 - DNA, 27 bp, Artificial Sequence
  PRIMER
aaagtcgacctcctccgccttcctttg

SEQ ID NO: 11010 - DNA, 36 bp, Artificial Sequence
  PRIMER
aaagtcgacctgtctttaagagttaacgaaaacacc

SEQ ID NO: 11011 - DNA, 31 bp, Artificial Sequence
  PRIMER
aaagtcgacctgtttggactctggagacgag

SEQ ID NO: 11012 - DNA, 31 bp, Artificial Sequence
  PRIMER
aaagtcgaccttacaaagccatcccaatttc

SEQ ID NO: 11013 - DNA, 26 bp, Artificial Sequence
  PRIMER
aaagtcgacgaaacccgcagatggag

SEQ ID NO: 11014 - DNA, 31 bp, Artificial Sequence
  PRIMER
aaagtcgacgaacaatttgaagaaacagtgg

SEQ ID NO: 11015 - DNA, 31 bp, Artificial Sequence
  PRIMER
aaagtcgacgaagaacagccttgatttggtg

SEQ ID NO: 11016 - DNA, 31 bp, Artificial Sequence
  PRIMER
aaagtcgacgaagcgatcttagcttctcttg

SEQ ID NO: 11017 - DNA, 30 bp, Artificial Sequence
  PRIMER
aaagtcgacgagaagcggtgacgatagagc

SEQ ID NO: 11018 - DNA, 28 bp, Artificial Sequence
  PRIMER
aaagtcgacgagtcatgcggatggaaac

SEQ ID NO: 11019 - DNA, 31 bp, Artificial Sequence
  PRIMER
aaagtcgacgatatgggtaatttgttgctcc

SEQ ID NO: 11020 - DNA, 30 bp, Artificial Sequence
  PRIMER
aaagtcgacgccgtttctggtaatctcagg

SEQ ID NO: 11021 - DNA, 31 bp, Artificial Sequence
  PRIMER
aaagtcgacgcgagtaatccacagattgacc

SEQ ID NO: 11022 - DNA, 26 bp, Artificial Sequence
  PRIMER
aaagtcgacgcggagagagggccaag

SEQ ID NO: 11023 - DNA, 27 bp, Artificial Sequence
  PRIMER
aaagtcgacggtggatggtcatgggag

SEQ ID NO: 11024 - DNA, 29 bp, Artificial Sequence
  PRIMER
aaagtcgacggttcagcgggtattcttac

SEQ ID NO: 11025 - DNA, 30 bp, Artificial Sequence
  PRIMER
aaagtcgacgtgagatcgcgagattgtagc

SEQ ID NO: 11026 - DNA, 31 bp, Artificial Sequence
  PRIMER
aaagtcgacgttgagagttcgttccatctcc

SEQ ID NO: 11027 - DNA, 31 bp, Artificial Sequence
  PRIMER
aaagtcgactaacacaataggaggagcagag

SEQ ID NO: 11028 - DNA, 31 bp, Artificial Sequence
  PRIMER
aaagtcgactaattctagtggcttgacctcc

SEQ ID NO: 11029 - DNA, 31 bp, Artificial Sequence
  PRIMER
aaagtcgactcagttaatcaccgagttgttg

SEQ ID NO: 11030 - DNA, 31 bp, Artificial Sequence
  PRIMER
aaagtcgactccaatcaatctcttcctttgc

SEQ ID NO: 11031 - DNA, 28 bp, Artificial Sequence
  PRIMER
aaagtcgactccagagagacgccatgtg

SEQ ID NO: 11032 - DNA, 29 bp, Artificial Sequence
  PRIMER
aaagtcgactcgattcgaaccatctctgg

SEQ ID NO: 11033 - DNA, 29 bp, Artificial Sequence
  PRIMER
aaagtcgactcgctagtcacctaccgcac

SEQ ID NO: 11034 - DNA, 35 bp, Artificial Sequence
  PRIMER
aaagtcgactctcgtaataataacacaataggagg

SEQ ID NO: 11035 - DNA, 31 bp, Artificial Sequence
  PRIMER
aaagtcgactcttgtttgattcacgttcttc

SEQ ID NO: 11036 - DNA, 31 bp, Artificial Sequence
  PRIMER
aaagtcgactgagacatccaccatatcttcc

SEQ ID NO: 11037 - DNA, 27 bp, Artificial Sequence
  PRIMER
aaagtcgactggctggacctggactcc

SEQ ID NO: 11038 - DNA, 28 bp, Artificial Sequence
  PRIMER
aaagtcgactgtacctttcgctcgcctc

SEQ ID NO: 11039 - DNA, 29 bp, Artificial Sequence
  PRIMER
aaagtcgacttcttgcgcctagtagcctg

SEQ ID NO: 11040 - DNA, 28 bp, Artificial Sequence
  PRIMER
aaagtcgacttgaaatggcagacgagga

SEQ ID NO: 11041 - DNA, 26 bp, Artificial Sequence
  PRIMER
aaagtcgactttcgtctcgcggtgag

SEQ ID NO: 11042 - DNA, 31 bp, Artificial Sequence
  PRIMER
aataggcctggagcgtctcacacttttcttc

SEQ ID NO: 11043 - DNA, 37 bp, Artificial Sequence
  PRIMER
aatggatccaaaaaatgttatcttctacctccttagc

SEQ ID NO: 11044 - DNA, 27 bp, Artificial Sequence
  PRIMER
aatggatccaaaccctactcggctcgg

SEQ ID NO: 11045 - DNA, 28 bp, Artificial Sequence
  PRIMER
aatggatccgacctgagcagtgccaatc

SEQ ID NO: 11046 - DNA, 26 bp, Artificial Sequence
  PRIMER
aatggatccggcatttcctcgaacgc

SEQ ID NO: 11047 - DNA, 31 bp, Artificial Sequence
  PRIMER
aatggtaccgctacactatgcctctgctcag

SEQ ID NO: 11048 - DNA, 31 bp, Artificial Sequence
  PRIMER
acaggatccaaaatttcaccatgagaaccag

SEQ ID NO: 11049 - DNA, 31 bp, Artificial Sequence
  PRIMER
ataggatccaagttaacttcacgcagcagct

SEQ ID NO: 11050 - DNA, 28 bp, Artificial Sequence
  PRIMER
ataggatcccaagtcttcgctctcgctc

SEQ ID NO: 11051 - DNA, 30 bp, Artificial Sequence
  PRIMER
attggatccgcttctctcttgtcttgctcc

SEQ ID NO: 11052 - DNA, 30 bp, Artificial Sequence
  PRIMER
taaggtaccttaccaccgtcattcatcagg

SEQ ID NO: 11053 - DNA, 34 bp, Artificial Sequence
  PRIMER
ttaggatcctcacgccagttagctgaagaatctg

SEQ ID NO: 11054 - DNA, 33 bp, Artificial Sequence
  PRIMER
ttaggtaccttaccatggaagaacgaatctagg

SEQ ID NO: 11055 - DNA, 30 bp, Artificial Sequence
  PRIMER
tttaggcctaaagaatggagatggctttgc

SEQ ID NO: 11056 - DNA, 40 bp, Artificial Sequence
  PRIMER
tttaggcctactactacactccagctactaatcataagca

SEQ ID NO: 11057 - DNA, 36 bp, Artificial Sequence
  PRIMER
tttaggcctcattctgtaattgctaggtaatatgcc

SEQ ID NO: 11058 - DNA, 33 bp, Artificial Sequence
  PRIMER
tttaggcctccgaagttatgtcattacatcgag

SEQ ID NO: 11059 - DNA, 34 bp, Artificial Sequence
  PRIMER
tttaggcctctaccacctttacatgtaggacgag

SEQ ID NO: 11060 - DNA, 35 bp, Artificial Sequence
  PRIMER
tttaggcctcttgaattgctagtaagagactggct

SEQ ID NO: 11061 - DNA, 32 bp, Artificial Sequence
  PRIMER
tttaggcctggtaggagcgtctcacacttttc

SEQ ID NO: 11062 - DNA, 35 bp, Artificial Sequence
  PRIMER
tttaggccttcaaacaaaaagaacaattcaatgtg

SEQ ID NO: 11063 - DNA, 33 bp, Artificial Sequence
  PRIMER
tttaggccttcacaggagtggatttcatgcttc

SEQ ID NO: 11064 - DNA, 32 bp, Artificial Sequence
  PRIMER
tttaggccttcactgcttctctcacttgctcg

SEQ ID NO: 11065 - DNA, 34 bp, Artificial Sequence
  PRIMER
tttctcgagtcatcatatgagggtgagctgtagc

SEQ ID NO: 11066 - DNA, 31 bp, Artificial Sequence
  PRIMER
tttgaattcctcagcgtcgtctatctgtctc

SEQ ID NO: 11067 - DNA, 36 bp, Artificial Sequence
  PRIMER
tttgaattctcaaccagtgtacgctcatatctgaag

SEQ ID NO: 11068 - DNA, 33 bp, Artificial Sequence
  PRIMER
tttgaattctcaacctcacaatttgcttgatgc

SEQ ID NO: 11069 - DNA, 29 bp, Artificial Sequence
  PRIMER
tttgaattctcaacgtcagtcgtcgtcgg

SEQ ID NO: 11070 - DNA, 32 bp, Artificial Sequence
  PRIMER
tttgaattctcataacagaaggggagcacctc

SEQ ID NO: 11071 - DNA, 34 bp, Artificial Sequence
  PRIMER
tttgaattctcatcacacttccactctccacatg

SEQ ID NO: 11072 - DNA, 36 bp, Artificial Sequence
  PRIMER
tttgaattctcgatgatttatttgcattaattgatc

SEQ ID NO: 11073 - DNA, 33 bp, Artificial Sequence
  PRIMER
tttgaattcttaacattacatgtcttgggccag

SEQ ID NO: 11074 - DNA, 29 bp, Artificial Sequence
  PRIMER
tttgaattcttaggcgtcgaccgtacgtc

SEQ ID NO: 11075 - DNA, 32 bp, Artificial Sequence
  PRIMER
tttggatcctcaccatgagaaccagtaatcac

SEQ ID NO: 11076 - DNA, 38 bp, Artificial Sequence
  PRIMER
tttggatcctcagtgaataaaccccatctaactcttcc

SEQ ID NO: 11077 - DNA, 31 bp, Artificial Sequence
  PRIMER
tttggatcctcatatttccctacatcaagca

SEQ ID NO: 11078 - DNA, 29 bp, Artificial Sequence
  PRIMER
tttggatcctcatcagactgcgtcccacg

SEQ ID NO: 11079 - DNA, 26 bp, Artificial Sequence
  PRIMER
tttggtaccaacaagccatggcagca

SEQ ID NO: 11080 - DNA, 33 bp, Artificial Sequence
  PRIMER
tttggtaccacagtgctctgcctctagttctca

SEQ ID NO: 11081 - DNA, 32 bp, Artificial Sequence
  PRIMER
tttggtaccctactacaatccggcagagacca

SEQ ID NO: 11082 - DNA, 42 bp, Artificial Sequence
  PRIMER
tttggtaccctactagtgaccatcttcagtatttactacgct

SEQ ID NO: 11083 - DNA, 38 bp, Artificial Sequence
  PRIMER
tttggtacctcaacctgttatttagtccatcgctttag

SEQ ID NO: 11084 - DNA, 33 bp, Artificial Sequence
  PRIMER
tttggtacctcacagttgggcaaggtaaccttc

SEQ ID NO: 11085 - DNA, 28 bp, Artificial Sequence
  PRIMER
tttggtacctcagcagtcagcagattgc

SEQ ID NO: 11086 - DNA, 36 bp, Artificial Sequence
  PRIMER
tttggtacctcatgcttaattagtacctccaagcac

SEQ ID NO: 11087 - DNA, 37 bp, Artificial Sequence
  PRIMER
tttggtacctcattcaagctttactctgttgtgactc

SEQ ID NO: 11088 - DNA, 33 bp, Artificial Sequence
  PRIMER
tttggtaccttacagcagaaatttgaagttgct

SEQ ID NO: 11089 - DNA, 38 bp, Artificial Sequence
  PRIMER
tttggtaccttactagttttgaacatcaagacttctgt

SEQ ID NO: 11090 - DNA, 31 bp, Artificial Sequence
  PRIMER
tttggtaccttatcataccagggaaagccag

SEQ ID NO: 11091 - DNA, 28 bp, Artificial Sequence
  PRIMER
tttgtcgacaatcaatgggggatttgtc

SEQ ID NO: 11092 - DNA, 26 bp, Artificial Sequence
  PRIMER
tttgtcgacacgatttccggaggagg

SEQ ID NO: 11093 - DNA, 30 bp, Artificial Sequence
  PRIMER
tttgtcgactggctttttgatcacaatttg
